United States Patent 7,767,387 (THERAPEUTIC TARGETS IN CANCER) - sequence listing, part 3

SEQ ID NO: 163 - DNA, 721377 bp, Mus musculus
  misc_feature (1)...(721377): n = A,T,C or G
tcagaccaagcctcactaccattcccctctccccgaggaggtcctggtgaccaccaggcatgctctgcactgacctcaggggaagacttctgtgagtagcagctctctctctgagttcagaggaggtacttgcttcacatgttagcatctctctttccacatctgcagagtggacccaatatgagttcaagccagtaggaaagttcaatctctctccggagtcaacacatgaagaatgacttcatcctatgttcccatctcgagattaaatgagaacagtgcaccccattcagttctcccaaacccagttgcccccaagttggcctttgcctcaggttaaagggcctcgtgctcagcaccgagttctgatgcaatgacaccattctctttcatcataccagctcttatactcttatcatgcacttttattttcaagacatccatagcctttcaactactatgtgtggcagtgctgatagtctaagatgtggtgtccggaaatcccttttgaagtgaactaagggtgttggctgagaaccagtgtgacccaagcaatgggggaactgtgtgtgttcaatcctgaagtccatgaggaatccatggcagtgtcccacctcactgctgggctaccagtcatgtttgtgctggcctggaaggaagggtgtgctgtatcttcatatggtttctctgcctgccatctctgctctaggggttctcacacaagtctctgtggaggaagctaggaaagaaggggcagagccctctggactgtgtgatgggaaagataaattctatagtctttagattggttctcaaatggactcaagtactcccatgactttaatggaaagccattttaggaggtcccaccctatgatggaccattggatttaatggacagccatctcgataggctagcagattaagaagcactggacttctaaacacttaacagaggggctagaattcccacctggaccattggacttcagacagaatatgtcttgaaataaaaagccatgaacacatacttgccaatctgtctctgtacggtgtcaccaagtcagaacttgatagaagagctgagagcaagtcagataaaaagctttaagcccacaactatccatcattccaagagttcccagggcggctagggcagtctgtggcttactttgctcaacttacagctttcaattttgtgataaggagagaacaaaatgagattgataactgacttaaaaggaagtgtctgcacgcctttcctcagctgagcatcttctggaaaactgatgtcacctagtgttcttagcacccatcaagcctattcctaaaggtaagtactacagcatgcggggaaacttctgcctctaactccaccttgacctatgtgtgcagtgcttaaggtatctttctggaagtgcataatgcttgtgttcaaacgggtccccagagagaaaaagctgatgacattctctatagatattgccaaaagtcaaggctttagctcctggaataggcagagttcatatctctccatctttgtttctctctgtctttttgtctctctgtttctctatgtctctgtctgtctttgtctctctgtctctgtctctatctctgtctttgtctctacctctctctctgtctctatctttgtgtctctgtctgtgtctctgtttctctgtctttctgtctctctctctcatgtgtgggctttctcgagaatgtctagataattgactgtgtcacctctatctttagctgtcctttagatttgtaagataaccacaccgtatgccctggaaaatgccaccaatgctagacttaaggttgcaaatctggggcaaaggtgagaccacctctaagattcctgtgcacagggaacaatctttgctttaggttgaatacattctgagacgttcacagcattctgtggaaacatggccagctccttgcatgaatatatttgatgaacttccctcttgaactcagagaccagtttatcgctgtgtttcccttttatggctcattctcttgaatctcccagggcgctgctaaattgaaattttggttggtttgttttagaaagatgtgagcaaagctgtgtttcttggtttcatacaaacaagctcacccctcataaaatatcatggctcataatctttttgagccattagaattgtacttcattttggaaaatagattgtttggtaactgtggggatactgaagccaaagatgggatagacttccaagaaagggagctgttagctgttacagatgtgtgtgtgtgtagatgtgtgtttgcaggtgaatgtgcatgtgtgtatgtgtgcaagaatatgaacagaggctgacatttagtgtcttcctgcattgcaggccaccttattttttaagatagggtatctctgtgaacttggcattcaagagtttgcctagacaagctggccagtgagtcccatggatcttctttcagcttctccagcactgagattacaggcaagtacatatggttttctaggtagatgcaagggatctgaacttgctcatgtcccatgcttgcgctgcaggcactttatcctctgaactaccttagactgtgtcatcacaaaacacggtgcagcatgcacaaatcagaatcagaagccaggaagcccatcccgggccaccactgacatgtttgacttcatggattcttattcccatgagtgtttctaagcaggaagtttgctctcaacaccattctcatctgaggggcaggagtaagtcctctgccccatctatatgctgtctcgtgtgccaaagtccttatttattcaggacaaggaattgagtgctggactccccagctctggaagcagagcttctgcacagattaaactaggaaccctgaaggaaataaaaagagtagccagtgctttggtctggaagcctgaaacacacaggaagcacagagagactcttcctttttgttttctctcagcaccatagaagaaagcagactctctggttcgagaagcctctctcaggaaggactcaagacactggtagtctgcttgagacaatcctagcagagtcgacagggacagagagatgagcagaattgtcttctggcagtccagcaaaatggaagtgaaaggtgccttccagtcagggcgtgatctctgagttgactctatcaaccatgaccctaaatattggtaccatcttggacaaaggagagtgtatgttcctgctagcttccatctggactgcagaagggtctatggctgaggacctgcaagagcatgccacttttctccaaaggccatggtttctctccccgagacagggtttctctgtgtagccctggttaccctggaactcaccagttcttgcctagaccaggcttgtctggaactcagagatctggctatctctacctcctgaatgcctcctgaaagctgggattaagggtgtgcaccactgtgcctggctaaggcaatagttttgatgtgttagaaaagggggcaattactttgagactctcatgccctgactcaagttctttgctaggcatgggctgatctgaggtctgtgatgtagtaaggggcaggaaaggaccctctggccagctggtctcagctagacatctactgaggccaggatgtaagaatatcaatggaggccttctgacatctctcagctactgtgagagatttgcacacagttttagagcttacttttatatcaattttttaggataagccacatgtcagtagtatgccatctgctggtctgccactcagttgtccttcttgctgtctcccaagctctttaatgacagagaaaatccttatagtttgatgttaaaggaaagtagcgtgaatgttttatgttcagacccacaggaaaagtctaaaaaaagtctaaaagtggttagatgatctgtgggtggtgggattctagggagattcaatatcctcttatgaagattctgtagtctgattttttttgtaataagcctgaattaatcatttaaacagaaataaatacaaagcaaatattaattagttatgaaaagaaaacctaacctactcagatctgctttcttagtctctttccacccaacgaacatttggaaacccaaaggcccttggatatagttttgagagttgggccactgtgcttctcctcctttgtcataaatcagaaattgttccagagatagaggactcttggcatgtcaagtagctcgatggagaactcagcctccttttcttgaagctgtaaggaggtggagtagctactttcccatcttctaccacaaataaattataaggaggtgagaaggcagcagtgcaccatggtaattgtgtatgtgtgtctgcatgtgtgtatgggcacacatatgcttgtcgatagtatgtgtgtttatttgtatatgtgcttgtgtgcatgtgtgtatgtgtacacatatgtttggtgaccacacttgcacaggccagagggcaacctcaagtgtccttcctcagacaccatcccacttttctctgagagttttctttttccctgtcactcatctagtggttagtctgactggtcagtgactcctagggatctgcctgctccagactgtccagatctaagattttaagtgagcctcatgcccagttattttttttaaatgtgcacattagttctgagcgccaatctcatgttgccaactctctccagcttttcacatcatgataatttaaggaagtgtggagatactaatgacagtcatagccaagatggagcattagattgtgttgtggaaagaacatgaactgggccatctaccttcataccaacactttatatggtacagaattcataagtgaaaagttgatatcatcttggatatgatatttctctttacttttacttaaagcatttaatttattcattttatgggcgagcgttttatctgcatgcctatatgtgaaccacatgagtggttgatgccttaagagattagcagagggcaccggatttctcagaactagagttccagatggttgtgagccattatgtgggtgctgggaaacaaagtagggtcttttaggagccacacatgccctgagccgccggggcatctctccagctttaacatttaaacagacaaaaattgtatgtatgtatattgcacagcattatttgaaatatttattttttgtgggatgaatagctggtgaactcaagctgattagatattacctttttcttgtatgcatctgtggtcagaacccttggtgtcccttctcaagtttactaaccattattaactgtagtcagcatgtgtcctctaacgactatcacccaaacccatcgttccctttcccgtgcttacattgtttgtttgactgtgaaatgttcttcaggattttcaggtctcaactgaatgagtcagcctccctttgaatagtcaccaagtagtggtctaccagaagacgccaccagaggacgccacatcacttagggaggcattactgaatctcccaacagattcgtaattcctttttgtaatgtgagtctcagggttcattaggtccaggctggggctggagaaaggtgaagctcagtgacactgtgacactgctgacatctgcgtagacagcctttcagtctccctggacttcatttttgtttttttagtttgtgtgcttgtggtcttcctctcatgtacttcttttaagtcccatgggggaatacccagcttagaataggtaacagatttgaaaacccaggcttgctctgaaggtgaccatagacacatgtgcatttgctgaagagtctgggaagctattaaatgtatttacaggcaaatgaatggcctcactataagtttctacttttatttctcctgcttttatttcttgtacaatccttctagatacccaatctgtagacacgcctacagaaggtagagatgatgctctggggttatttgtagatacttctagatcttcccattttccaggctaatgaaagagtaaaaagacaatcagtaggcatgggtgacagatcctgtgcaagctggatgggttctgttcctctggagcttggccacagcctggtatgtggccctctgggataaaggctacagacagaagagctcagagattcctgcagctgtgtggtcctgctccaactgtctttctgaggggctgtgtgggtgtacagagcagtaaagtggaggcaggggcccctaattgctgctcttcccacggattgcactctatgagcaaaacccggggccagaagatctgatctggtcccagtttgtccagtttatggagtgtgtgtgtgtggtgtgtgtgtgtgtgtgtgtgtgtgtgtgttgtggtgtgtgggtctaatgcacagtgcttggagggcataggttgatgccagatgttttacttagtcagctttctaccttaattgaggaaggctcaatttggagcttacccctcctggtttaattttgtttgtttgtttgtttgtttgttttgttttgttttttggctttgctattcatcctgaaactcccctggtatctgtatttctttctacctcccagcatcagagcatatcactatgccttgattttatgtgggtgctagagatctgaactcaagcatttttctcaccaagttctctctcttgcctctggtttctgtttttgttgtagctctcggaatgaacagcacaagcctgtgatgtccaaggttccttttgaatgtgaggttcctctgtgtctagggggagagcctcttcttaaaaggctggtcagagatgggcaaaggcctgatgatatctacttctggtagttgggaatactctcattctgtgcctatatcctgagtaccctgagttcacacaggaacaggcaataatattgaccctgaaggtctctgatgaattctgatcaagtcatggttttggacaacactggagatgctgaaagcttcagtcagcaaagttaggggtggtgcgagagcagacagagtggtggctggagtaggtgtcttatgggacttctggagccctttaaatgatgatgatgataatggtaatggtgtggggacttcaaatgtgagaggacagaaggcacagcagccactagcatcttgttaagtcatcatgataatagttttcagggggatctaggttgtagatattaggtaggaagaacctagagggtaccactggctgcaaaggttcaagttttgctcctatgggaatacattctgaaggctcgatgacccatggtggggcaggacagtacctgtcctttgctgacttatgctatgaatgttatgagttttaaatgttaattcttggacttaaggaaagtccctcaggcttgtgtcaaggcacagacccagctggtgagaaggccaataaaggaatctcagtaccgcagcctcttgcacctctccccagcctttcaaagttcaactaccccaggatgttggaaaagcgccagggccattgaatgcatggggattgtgttgcagccctctgagtgcagaaggatggatgatgctgaaggggagactgaggcaatttctgcttctagaaaacaccatttattgctctcttctttagcacccccctttctgtgtgtgtaaatgtgagtgtgccccatagcatgcacatggacatgagagaatggttaacaggagttagcttattcctttgactctgtgaatttcagggatcaggcgcagggggtcaggtttggagacaagtacctttaccagcagagccattttgctggccttctgttgtgtactattttatgggggaggtgattttgaccttaagtcttttctaatggatatgtatactgagcccaaggaatgtaccaaccaatttgagactcacatattttcagtgtctgccaggcttggccttctttggccctctgtatcctagggccagggtgtggctgaccaatgatttaggtcgagacagcttgttcaggtaaggaggctcctttgggccagtttaccatatgaagagtcttgaaaggaacctgagaattccaattagactataactaatgagctggaaactttggggaaatcactgtgggcagtgaggggagagtgatcatcttggttttaattagcacaggaaaaagttgtggtccagctgccagcctggagaagtgtccagagggaggaagtttctgtgtgcaacgatagggggactgggggtggggcgggggacaggggctgctgaacaatcctggactccttccctttaaaggggagaaacgggagaccagaaatgtagaaaggcaagcctgaatgcagagtacccgtcatccatttgcccttcccacacgagtctaaagaactaggaagcagccctttaagaaacctccttttctacccagtttgttccacaccaaccaccaggctgctgtcatctttgcttaataaggaaacaacaaacaaacaaacaacaacaaccaacaaacccacctgcagctgtcagaggtcacagactaccaacagacttccagatgccccagttgttcatcagcaactcacaacgtggcatcttggaaacgaaagagtgaactctctgtcagcaggtgtactgtactggctagggtcttccttagtctccaagccttagaatctaggggcaataagtccactgaatctagctgacaaccagccactcctctccctattaggggcccctttgggaaaaccggcctaccccagacacctggtggtttccccttctggtaccctgctgagcctagaggggcgcaacacctgcaaagtcctacctctaggctggtggcgctatactctacatcctggaagatggggggccgcatgccccaccactgccaaatgacctgctgcccctacacagccccaagccgaggcgagttagcccggtaagcctcctcccctcccgcttcgggctgtttgagcccgcgcccgctccagttgctgcagctgccactgctggcggctgcggggcgcgcggggcgcgcgccgaagaggctcgggctgcgagaacggggacgaggaggagcccgaggaggcaaggaggaagaagcgagcggaggccgaggaagctcagggtcacagagacccggcccgaaggggtcccgcagagcatcggctagctggccgcggaggcagggcagaccgccgcaaccaacctgccgcggccccgcgagcacaggaggcggcgatccaggagcggagcgcagccccggggaggaagggtggcgcgggcacgcccggtcgggagggcgcggattctccgatcctaaggagctgtcgcctcatcacccgagagagctgtgcggggacgggcgggagaccccgggcccgggcgcagcgcacacgcgtggcgcacgccaggcgggccgggcggcgccgagggtacgcgggatcgcgctcacggagcttcgggaggcacagaccccgggcgcggaccgcccgcggcgccccctggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccgcggcggcggcggcagcggcagcagtagcagcaacatggctgttgatgggtgttcggggtggcgctggcggcgggaggagctccctcgagcccctgcgcctgccgcccattgctagctatggcaaacggtggcggcggcggcggcggcagcagcggcggcggcggcggcggcggcggaggcagcggtcttagaatgagcagcaatatccacgcgaaccatctcagcctagacgcgtcctcctcctcctcttcctcctcctcttcttcttcttcctcctcctcttcctcctcgtcctcggtccacgagcccaagatggatgcgctcatcataccggtgaccatggaggtgccgtgcgacagccggggccaacgcatgtggtgggctttcttggcctcctccatggtgactttcttcgggggcctcttcatcatcttgctctggcggacgctcaagtacctgtggaccgtttgctgccactgcgggggcaagacgaaggtaacgcgcgccccgggcgcccgcccctgcgccatcccagccgtttctcggcgtcccccgcagcccacctcttagctccgcactgtgtcttgcctcctgctgtccctgccagccttgtccccgccgcttgcccttccctcccctctccttgtgccctcggattgtgcgccaggggtgaggagttgaccccagcaggtgcgctccaggacgcagacccccgctttagttctctgtttattgtagggctattggtgactatggccggacccgggttggggggacatgtgtctcttgggcacgttgttgcggagtgtggagaaggaaccttgcagggacacaggaagctgaaagaccctgggtgcgtgcgggacaccactcactggctgcggccagactcctcacggtggactagttgggacagatcagctcatacttttgttgttgttgttgttgttgttgttgttgaggaaatcagttcctggggtcccaaagaagggggaatcctttgagctagggagaaaatcttttgcatctgggaattctgggggggaaatcatggagaaagtgggggcccacggatcaataaaaagttgggaagacccatcctagaatggggtcaatctatggagagtcactttctaaaagtggcatggttgcaagtctgatgtcaccgcccactccatcccttacattttctttgtggaacattaccctaccccaagtacttttgccacctctacactcccctcccaggccatcaactttggatccccacaaatacagccagcagctccaatctgtagcaccagggctgcactcctaagagtccaagggacctctgcttcactaagcccccttttggcacttgatgtggctagaagtcgtcttaagctattcctggcagagtcgcccacagtgttaggactcacatctcagatgtgtggttgctaggctttactcctgggctgtggccatctccctagaggggtccctgcccaccacctagcacttgctggggggcggtggaccgggggtgggcaatgtttgagcgagaactacagaatgaataaaagaaagaactgggaaaaaagaggagctgaactgggtgcagtcttttagagaaattctcatccaagaggacagaatagcacccatacttttggacagaggatatctctagggggattgtgcaagacactcatcttggtccccaaatgttcacacctgctctagaaaagttcatccgggacccccttgagaagtcacagggctcagcaacttgtagcagcgtacagctgctaaagagaagagttaggctaagggggaaggctatgaaacccaagggcaaccgaagcactctctgtcattaattatacatcaccgtaggtgctgggctcagctgtgttttgtggcagcacatttgtgttttggaaaatactggtgtgttggaataagggaggaaaaagaaaaaaaccacccttccttctttgcttcctcttggcattgctctgaaagcctccaatggtgacaggtgagctttgtttagagtccccttcttgaggatggaggttcccccttccttttcaaggagaaagaccgatggccttccagagaagccctcagattaagcaaggttcctatagccagacccagagatggtctctgtctgatcatagaatcacattcacccattctttctcctgcatcttcagcttgtcctgggagtgtctccctctcatactgagacttggtgactatctttagttgcacgcatctcagttactttctatatggaagtgacttgggttggctttttaaaaaaactactttctgttttcagaaagtgaacaaatttggtcataatgagtcctttttgtctttctaaggttttaagcggagcgtctagcatctttttactctagggggtaccctgtgctggtatagtgtgtgtcatgaaatgtctcttaaggaatttacataaagaatcccctttctaaataatgaccagaatagcttttgccagttttctcagaaaaaaggttttgtgtaacaacaattaaaaaaaaaacaaaacaacaatccgtacctattcctctacatatattttagctttaagactagtggagtgcacacagttgagagtttcaatgcagaccctggagtaaaagatgattgtggttgattggaaagattgaaggtcaaaacagaatagcatcaagctctttttggtactgtgagttcctttagaatcgtgcccagttttcttaatatctgcctcttgattcgttggattaaattgtgcgtatactcaactccctgtacctaacaatggtaaaagagaatttttaggtgcttccctttctaccttctgggctctgcatttgttttgcagttattcatctcctctttgctttccaagtattcagtagttttgttaagactcggtacagaataaagaattcagctcaagtttagaacacttgtgacttgccaggctccgtaagcaatcctctgctgcctttccacagaatcttctgcccaccctcaagcctctttgcccaccctgaccctaatccgggtccagtgtggcttactaggagctggagttccggagaaggtatcttctcagcatctgacattcctgaggggacatgtttcggcaggagcctggaattttatatatttgttctccaggtctgcaccgtggttttttggtcaaaggaacccaagactgtggacatatatctcagggtctctgttcatttgtgcctctggtctccaaataacacatagctaatgacttcatcatcatcattattattattattattatcatcatcattttttttaaaggattataaacatttggggagaagaagggaggaacaaagaatatttatgctaggtgtggtggcctgtgcctgtaattcctgtactcaaagacagtggcaggaggattgtgagttttaagtcagcttggactaggtagccatagcctgtctcagatagtaggagagtgaaacaggcacacagcaaacctcaccactccacccctgattggagcatggttctttgctgagggttttcatgctattgcttctctccaccaccctggattgtatcagtgtgcactggtcatttggccacagaattttggggttcagtctggtcctagattgtagcgagctggggaactgttcaggcagtctgcataagccatttaacctctctggtccctgggaaatctgaggattggaccccgtaagttccaatcacctccctctgccttgggaacacacgtaggagaatggaaggacagagcagtttggggaaagattttaagctcagctttgtggtccttcccattcctttggacacctatgtgtcttcccccaccccctgcccttgttttattcatctgctagcgtgtggtcaagtgtttggggaagtaggccatttgtggatgggcctctggtttgctgaaggacctgcctgtggcaaggcatagacggaccgataatctcagtcagagctatcatccctatagaacctcggtcttggtcaaggatggtctgcatgttgtgaattattgaggtgttgtctccatggctatgtctgagaaaacaacacattttctccgacaagctcgtgactaatataaatatcagatcccattatggcttggtaattacccagggtctggtctggtgcattcaatcaggactgcggcatcagcaccctggaactctagattccagattggcctcagtgcctggtttcctcttgtcctggcaattgccagcaccgatgacctccacatactcttttgtggtcagttcacctagggtggctagggagatactgtcagcccccagtcacgggggatctgacctggtcttgtccagatagcttgttctcattggttattaaaaattttaattttatatgtacctgagtatacagatgtgcatcaagtgcacgcagaagcctgtagaggtcagaagaggggttgggtcccctgggactggagattcagatgtctgtgagccaccatgtaggtgctggaaaccaaacctgggtcttctacaccattggtaggtgcttttgactgctgagctacctctccagagctgctgctgtattgcttatttttattttattttgatggatattttagactctacagttaatagacccagaataaaggctgttgctcccactcaggagggtatctttggctgacagtgagccttatttcctcatctgccagaggagcccacggacacttaactttgtagaattcctataagaagcatcaataacatgggtgtctagtgcccaacaaacacctggcactagcgggcctcttggaagtgagagttaccacagttccaccaagtgagaagctgttttcgctgctccgttaaacagaagccgcagaagggcacacactagaacagatagaatttgggaaccaaaaggagcctccagaaccagcaacacgaggtcactaacctgttcaaagtcactgagactgtgtctcctggctctggattgcttcgagctatggtgatggggatctggtgggtgaagaaagatctatgggggatgccctgacaacatggttgatgtgttgatgatggggctgtgggtgggcccttgatggtattggtgtctcagagaacagggctggcagaagaaaaacattgtaataggcaccgggagatgtagctattcaacagtgtgtccttgaagagggtggattccatccctggtaggccaggcagtcaaggctcccagaacgatgttccctgcctcccagggaggtcacagaatcctaaccactgtgctgtgcaaccagaccagctcttccttggcagtctttacaacagggtttcccaaagtatgttctggtccttgcccttgaagttaccttgggagaaattggtagtgagggccctggctgagtctctactgggaggatctcattataggtctacagaagtctggctggtagggagcttgctttaagcatccttctccccaccccccgtcccctgctacccactgtgtagtagacaagagtcagcctgtgaccttggcaaggacttcagtggaggtgcctcagtttccttcctgtcagactgagactcataataagagcacagccccaagcttctttcccttactttactgcagggagacatggggttcagggaagacgtggagttcatgcttttcttgcaagcctggggctgcttcttcttctagaggacaggaagagaccccctgctgtttggcctgagagagaagggaggcccagtcttttgcctccttccctcagcctctcctcttttttgtttgtttgtttgtttgtttgtttctgagaaaatgatcatgatttttttaattaggtatttatttcatttacatttccaatgctatcccaaaagtcccccacacgctcccctacccactcccacttcttggccctggcgttcccctgtattgaggcatataatcggcctctcttcttgaccacagaacaagtaactgtgctctttgggctgggctgctcaataggtgcttagtagcaggcagtaagtgcttgctctagggctcacttgtttgcaccgcccccttctctctctgtctctctttgaagcagttgagaggacattggattataatgccagggcctctttcccaaagtgggtagcaggagtgccctggctctcagtggcaatggctgtgctaatctgtgaatcacaacagccgacactaccttctcgggacttgagagctgaggagcctctagagagactcctttttggttcgtgggaaagggttgtgtttgtgcagtgacaccatagcccggggacatcatggaggactctgagacttatagagaaaattttcagggtcaggtaaggccaatctcccgcagaacctctgaaattccattgctgtacacagcaggagcagaccaacagtgtctccttcttccagatgccccaagttgctgtattcttggctttgggctcagtgagaagagaattcaggatcccatcctcatgtgcctagctttgtgagaagaaggtccgaagagtgtcggctgggctcagatttctgtctgcaaagggctgaaggaggaatctttgactttcatatatacaggatcacctgaagggctggggaaatggtcggatgcagaaggcccagggagcggcctgagcggtcgtgtttctgtaagagacaggccttgctgatgccatgcagagcctgatgtgaatgaacagtaagggcaggttgtctctgaagatgggcttatcctagaacatgtacacccctagctctcctatgtcatgaaggggtccagaatggacaagaagtggaaggtttgctaacatcagacagtcggggtgagagagatcgatgaggtggtttggggtggagggtgggcctgctgccgggttggatgctcacgattaaagctgcctctttgggtatcttctcccaaagagctttggggctggctttgtggtagccagggtggctttctgtagtttacagggagtggcatgccagttaccagccaatgtgtgggttcttcttcatgccagttggtcacactgtgaggggtgtggcttcccaaagtccagggtagccagttagccaaaccaccatcttgcaaaattaaaggttacagctgtgtgtggtggtccaggaggtcagctgtgagctaatcctactggaaaggttcaaatcaggggattttccacagggacctagggtggcctttaccaaatgggagggagcctcaaccttaaaggtatcttcaaggggaaagagtgctatcttcctttgtacttctcaaggattctagtagacaacagtgcaacagtgaaagtagtgcctttcccctccccctcttcccccacccccccatctgccactactagaagggatttcacagctctaactccgggactttccttgagatgttctttttaggttgttccattgtcaaaggaggggaacttagaaggagccatatgaagaatggccctgtacctggccctctacctgaccctgtacctggaggctcacagatcttcttcttaacgttagcaccgctggttttgcctttatcagagcatacatactgtgccagaaaccgagccaggtgccaggggaaaaaaataatgaagactggttctcacctcttgcccatttggactcagaatcatcagactgagcagagctaaaaccaggtcccttctcatggggtgtgtacagctgtgagtgaccctgagcagtcttcagattccttgagggcagaaattgagttatctagaaagaaacacaagaaacttagggtggtggggacaatgggaggtgcagattcatgtctctgctttgtgtgcatgtatgtccagagcacaatcttgggtgttgttctctagttattaaaaattatattggttgtcatgtgtgcatgttgtggtgcatttgtggaggacagtcaatatccaggagtcgcttttctctgtctgcctttatgtgggttccaggggctacacccaggtgatcaggtttgctcagcaactacttttcaatgagccatcttatcagcttcaccttgttttttttattgggacagtctctctcaatggtctggactcaccaagtagtctaggcttggggccagtattcccgagcgagcctgagtcaccctctcagctgtgggagtccaagcacacacatgagcctagctttgtacataggtcccagggatctgaactcaggtaggtcctcagtgtgtatggctctctgagccatctctccagccccatcttnnnnnnnnnnnnnnnnnnnnnnnnnnnnnnnnnnnnnnnnnnnnnnnnnagagagagagagagagagagaatggcttgatttggtgacaagctttggtgataaaattctagattgcttgattcatcctagattatgattattcacaccaccacagtgtcttgactagtgggtgaaaaggacttagttctcttgggcagctgtgtgtgaggggggatgagttgggcaaggggcagaaggagagtttcaaaagaatgctctcgttcagatggaatttgcattgtgtttggcattatttggtaattgtctttgggacattatgtctaattgccaatttggaaatgtaattggcactctagggccagaatggatatacttaacgtcctctagctgagcctgggagtcatcttcctgtacgatctcattacctgtgtgacgaatgcttctctacgtggccaatgcagaaattatttaaaacatcttatttacctttttactttcttttgcttttgtttttgaagtactgagtatagaacctagagcctcaagcatgctaggcgagtactctactgcttgagcgacgaccttaactgtttttccattttaatttgtgagcacatgtgtgcgtgtgtgtgtgtgtgtgtgtgtgtctgtgtgtctgtgtgtctgtgtgtctgtgtgtgtggtcttttctgagacagtctcactatgtagcccaggttggccatgaattcgtgctcttcccacctctgctccctgagtgctggcatcacaggtgttaccccagccctgatgcccccatattctgcccatgccgttttattggtatttcttaccaggttttcttgagaacccagatccagtggactctcaaccttaaaatgaccaccagcatccttttcttcttctctgtcttccatctggttgccttcccccttgtttcctttttccacagtgctttctcatcctggagaacttctgtggaacctggtatcatttaattttggtctttaaagacacacactagagcacaatgctaccatttaggcagagatagctagagaaagtgctacatgatttgtctatcatcagagtttaagtttaagagccagccaaagatttttttaaatgaaaaattaaattgtaaagccgggcacggtggtgtagacctgtagtctcagcagatgggaggctgagacagcagtatcattacctccaggtggctctacagtgagaccttgtggtgggagagaggaagaaagattgttacttgaagtaaaatctctcccatacatgatgatatctggagccataatttatattttaatattattattttaagtatttatcattattatttgtatttatgtgtactcacatgtgtctgtgtggatatattctgcctatggagtccagaagagggtgtctgatagagggagctgaagttacaggtagttgtgagctgcctgatgtgggtgttaggaataaaactcaggtcatctgaaagatcagagagcagccttaaccactaagccacctctcagccaaccataatgtttgcataagaggtttagggcaaggttttatgagatattcttttcagaattgtagaaagccattcaggcatgatgggtttgcctatgacatacatggattataaatggagagtctgcatatcggtcagtttccttgccatatcgtgttcttgttctcctgttctcctgagagcaggaaatgctctgttctggtttgggagtgaacttgggtgtgggaggactggagcggatagtggcttgtaagctaggtggttggtgggcaacaaacggggacttgactaagcaagtgtaaccacagctcatggtgggtagggctttggaggtctccccaagtgctggtgctcttctgctcccccagcaaaggggacaagtgtccatgatctcctgaggccaccattgcccaccttagagtggacctggcaagagctttcccgtttctctttgcttgtgccccatggctggggcacccagaacaagtccagagtagtagatttcagactgagcacaggcctggatggcaaagtgtatggatatcaactactctgtgatgatgtcaaagaaccttacctgtgatgcttctgtgtaggcagcttgtcctctccggtcacttttttggctccccctcttctcctgagacagtgaggttccctgttttctagtccttgacatttggaagcacggagtctccagtctgcccgatggttgtgactatgaagatcggtttagtctggctgcaagctgtgagtagtgtgtgtgtgtgtgtgtgtgtgtgtgtgtgtgtgtgtgtgtgtaaggagaaatgggattatgagggtggggggaaaaggtctaaggaaagaaaaagggtgtaacaagacggggatatataggtatatgtgccataaaagcagaaggcgaaactattttgagggaggaggggaccagcaagggtgaagagtaggggagggtgctgaggggggacaaataaaaagtaaagcatagtggaatatatgtatgaaaatattgtcacatggaaccagattcttggcatgctaactaaaaatccattttaagggagagctagaaaaagagaagacagacagacacccccaggagcacagaggaggaggtagggtgtgcagaatgatacagagacagtcacaccaggagcaatgacacttccccgcggggagctggaggctgggtccatgtgagactgacagagtttgatcccagccccttctccttggccctatttgaatatatcaggttgcctcacctccaaggagtggggcagagcagtagaaaaccactgggcacagtgactttcgtctctgcaacagtgcaggttttcacgacactttgttctgttaactgggcccttcaccacagaccagcagcagccccccctttaccccccctgcctttgccttctctctgtgcactttcttcacagtgtctacaggagctgtgctggtggcctgtgaattataggcaccacagccgaacaggtgatgggcttttaaggagtgcagaaatgatgtccctaaccaaaccgtcagggaaatgcaacagttggcatagctctaaaaaaaaaaaaaaaaagaaagaaagaaagaaagaaaaaaagaaaagaaagaaagaaagaaagaaagaaagaaagaaagaaagaaaaagaagtccatttcttataattatttgcaacctattttcctcataagatttagtttttgacttcagtgttttatatttttacttaatcctgagtactgtatgttcagtgtacaatgtagaacattgtagaaatgaagatgtagaccagacagaaaaaaaaaaaaagatacttcacacctgctgggatgagtactgttaaaaaaacatccagaaagttcacaagtgttgaaaaggtagtagagaaattagaacccctggaagctagatgggagggttttttacaaaattaaaaatgaactatcatggttcagtgtttccatttttggtctatgtctcataccttaggaacaaggacctggatgacgtctgtgtgctcacactgagagccgtggtacccgtaacagcccaaagtggcaaccaaggtgaagggagaaaccaaatgtagttcggacacacaagggctgttgtccggctgtatgagggaaggaccttgaatagagaccttcactgccttaagctaggtgatgatacgtagacatgaaagatgggactctactccaacaggcacctaggatggccaactcacggcaagtggtggttcctcaggtgatcgctcatactgggctccgagtttcagctttgcggatgagaacattcagaagagacttgcacaccaatgtgaatatgtttgttactgctgacctgctcagtgagaaacagttaagaaggcaggctttacatttttattttgctttattattttacgtgtaggggttttgtcagcatgtatgtttctgtgccacgtgcacgcagtgcctctggaggccagaacacggcactggatcccactgggactggagttacagatggttataagcagcgacgtgggtggtgggaattgaacctgcatcttctggaagagcagccagtgctattaactgctaaaccttctttccagctccaagaaggccaaacacattttatttatttctaatatttttcaataattgtttttataaatctaacatttggtaggctatggcagaggatctcgatttcgaggctaacaatgtcaaaacagggcctggggatgtaccttagtggtagagcactttcctaacatgcagaggctgcccccccaccccggtttaatccccagcactgataacacacacacacacacacacacacacacacacacacacacacacacacactannnnnnnnnnnnnnnnnnnncttgtagtctataaataggctgggattataggctagcagtgtttgattgaaaagaagccatgagaatcaactcactttgaagttttccctcaagtcatcctaaaaggcagccctgagccagcccggtcatctctgtactgttcagtgagcttcccagctgccgaagccgctgtggcaggggcaagctccaggaggggtgacccccaaatgtctaggtgctctctgaaccaaagtccccccaaccataaacagccagtacaccgggacttcctggaattacgcctttagattatataatagccattcgccgttaccagggccacgtattaaattttaacttgtcacaggtaaatgatgttaacagtttgcagagtcacagagtacgaggctgctccggggcttgctcagcacaccagccatcatcccacggccctgaccaaacaaacagaaagagagagaaacaaagggaagcaaaacccctcacaccagcacgagacccttctacagaggagttagcccttcatgagtatgtgtgcgtggtgtgtgttgtatgtgtattgtgtgtatgtatgtggtatatatgtggtgtgtgtgtgtgtgtgtgtgcgtgcacacaggtgattgtgactatgtatttcttacagaactagctaaacatttagacagtagagatggcaactgcagagtgatgtgctctgttcatgggcaggaagcagatatgatagagattttctgttttcgttttcccagtgacatgacgacgtgaacacctttttttttttttttttttttttttttagctgatcctttttttaagttggcagctgaaatgctagcatgctaatctctcctgagttgcatggaaactaataaaaccacgaaggtttctatttgtgctctgcgaacacagacggtaatgaaaccaaagcagccatctccaggggtgatgctatttaaatgccaggcagggcttgaaaatgattttaatggtggaaacagaaaccagctagtgagatgttgcttctcattctccccagtgtctgctcacctgtgtcttctcagagagaatatgtgcacacatatgtatgtgcacagacacccacctacccatgtacatccacacctcccacacacatgcacacatgcatcacacacgatccacatagatagaatttatttgcagtatgttaggtggatcctactttgctatggaagtactttaccatggcactgtgtccctagactgaaccaatttgtttatagcaaggccttccactggctcatatactatgtcatttgcttttgagcccagcagttagttctggaacattcttttgtaccctttcctgtttattctcaggtatccatcagtctccagatttatcactgtttttgttctgggaagttcttctgtgtgaactggaaatactgatgtctttcagaaaacaataacaagtttcttctgagtatccatgaggcataaacagtgttggaggtctcatatggtaattaggttatttgatcctcaaagtaatcctttaatatagacatttaaaattattttataaagttttaaaggttagagaataagcatgaggaataaaatcaaacttctcccacccctataggaagctttgtgtgtttactggtgttggggtactaagcactttatatgcaaatatttggattgaaccatccattgcggtaggtagtactatcactcttactttatggattagggaattgaggcccaggccatgcattagtgtggcagtagatctgggtatgaacctacacagtattaatgacctctgtaccccatatcccagggcctgttgtatgatgagtcgcttatgagtctagaggaactattgctataggactaaaaggtgtatgagagggtggacggtgttgcttagatggtggagtatttgcctagagtgcacaaagccctgggttcagttccccagttgtagggagctggatgggggcgggggggggggcgggaggtggcatcagaggttcaaggtcatccttggctacaagtcaagttcaaggccaacttaagatacattaggaccctgtatcaacgtttaaacactacacatacatgcccacacatgcacgcacatgcacattaccaccaccaaacaacaacaaggagtagcttgagcctcacacaccatttctccatgaggtgggaagtccttggttaagtgcagagaattccataataccaggattgaaatggatctgaagtgctggtcacatctcttaaattcatgagctgtgttgtcagaaaatggggcatgccccctttctctaccttcaataagtgggtgtactgtatgcagttatgcaggttcacctccagagctggtgtgagacttagatcatataacacatagttgtgtttgacaatctaaggcccacatgccaacccctgtgtcacagggtccatagaagcacaaaataaatatttgggtgagttttgagcatgtgtccttcaattggattaagcataagatacataattcaaacatgtttttaaaaggttgagatagaggttggaagttattaaaattcattctgttcaagcatgagggcctgagtttgagaccccagaacatacatgaacgctaagtatggtcacacttgcctgtaacctcagtgctgggaggcagagataggtggattggccagccagccgaggtggagctatgagattaccctagcaaatgaaaaaaggcagaaaagtaattggggaaaacactcggttgctgatttttgtgggccacctacagacaagtattccacacacatgtgcatatgcataagccatgcatcccaaacacacatacacacacacacacacacacacacacacacacacacacacacacagacacacacagacacagacacacacacacacacacacacacacacacacacacacacacacacacacacgagcacggggaagcagtaaagttggatgacacttaccacccaagccttcctgttaagccacagagataacagagctgcagatcctgatgtggaatggtgcccactattctctcatctctgggtgctacctgagtctctctcgaactctgttctttccttctatcccacgggtcttgggacttgaactcacactgatgggcttggtggcaaacgctttacctgctgaggatcctcactggctcctctctttcaaagtctgagactcttggcgatggaagggaagccatgcacgtgaaatagatagatctgagttctttggcttattggaatgacgtcacaggatggggggggggtcaggaaacccctcagtaggtgtgacccccttgctttgaaaggatcaccccctgtcctctggacctctttagcctggaaatacattattgtacctctctctcaatctctttctagatagttgggtgtcatgaccttgtgtattccaaaccctgtgggtagaacatttggaagtgggaaatggattggtcagttagtaaatctttacaaacaggattgtccttttcccagggatgtggggatcatgtgagacctttcttttctggtaatgccgtggtcacattgcatgattgcaggaatcccctacacattgtagttatgagcagtgacccttggagctctgtagtgcccaacctgtatatccatatgcctgtcttagcaagcaactagctgggctggtacaatgaactcacagaagaaatgagaaatgccataaacccctcttaaccattactgtcaaaacgagaaggcagaatgcaaagaacttgcgatccagagaagggggagggaatggatttggtcaaggagggaggggccagatgagcccattggaactgtggagttggggttacccttcaagcctcgtccctcaacaggctgtttctgtgctttctcatcactgtactcatgccctggcacagcaagcgtccctggttttaagcacaagctttgagaacgcctcctgtacacatgtcagccaggtgcgtccctgtggcccacgggcgagggataacaagaccctgaggatttagaagaggctcctctgcagccagctctgctattttcagctgctacctacagcctctgctgtcccaggtgtttgtcagcacagcatcctctgcatgaagcggaagtagctatcagaggccaggactttctcatccaggtcatggctgtccccttcccaggctgggtagttgatggtctcagaggctggcaggctgtagccaagcttctctgggttgggtgaaatgggcaggtggagacagagaaaagatcgttgccattgatgcctcttttcagccctgaggtgttgggcagctcttcatccagcagtggcttatcaataatcgctctggaactgctggctgtggcttcaaggtgctgcagatctgagctatatccctgttgccgggagacctggtgatagcatagcagagcatagttcaggaaggtccaggtgcagtagagggtagaggaggccttgcatggccttaggtggcccaagtcttcccctccaacctcccactttcttacccagtgcagattagttcaactgattaggaggatacctcccagggggccatcctccctctcttcagccagcctttcttttcttccttggcctgcatgggcatctgctgcagcaggcatctctactcccatgtggagtgctccctgtggatagaactgctacattttctctttggctctatgcctggctggtggtcctgaagggtactggtgcctctaggtgttggtagataatatcatgacttggtcttcacagaaaccatgggtgaacctcagcttgcccagctcctgttatttatgtgttggccttgttgcttttgcatcaaggctagctgggaagtgctctgaactagtggaatcaggcagaagggacttgatgtaacttcctgggttcagtagcaggacaccttgatatttccgtttgtctcttgggacacttgctgtctggaaattagtggccttgtgcagggtatctgactgctttgaaaccactatgtgtaagtccaaagtcccaggagaggtcctggaggaagggatactatatgagcagaaaggagacaggaaaaagacagaggaagtgcagtgagtatgggggagggggtagggaatgagtatgtgtgtactagacgcacatgaagacaccatcttggaactggatactttaagtcccacttacgcaaatcagagacaaattattcagttgattgctccatgcattcctgctttcagaataagaccaagaacagaatgaaatgattgggtttaagccactacttatatatcggggtggtttgtctgcaacagctgactggaataggtagtagttgctagaggctttccttaagactcagcttttgttctgccgcacagtgctctttactttgcttcatgatactcccctgtggagacctgatggctgaccaacatgcgaacatggtggtctgtcttgcagttagacaaatgtgagcttaaagcccactcctacactgcttgggggtattgagtcttatgagtaggcaacatggctactggaccactctgctggttctaggctgatggtctttccatggcattccttgagttgctgcttgcttcctcttcttacccagttgcttattatagtatctggtctgtgattgtgctgtggtcatgaaaacactgaactagctgcaagtatagtcaggctaggacagctgctgtaacagacagccccatcagtccagtgatatagggaacctctgctcgcacccagaatgcaaagaggcttcattctgagcctgggcctcttaaatttagaacatgtgaacatggtggtctgtcttgcagttagacaaatatgagcttaaaacccactcctaccctgcttgggggcgttgactaatatccacttcaatctccatacataaactggactccaaaaataccagctcatggaggttttgaggagatttagaaagcatttagcatcttgtaagcattgaacaaatggctgtgagtttaggtcagcagttctcgatctgtgggtcacgagccctcttgggaggttgcatatcagatgtcctgcgtatcagatatttacatcacagttacatcagtatcatcaaataattttgtggcttggggtccccacagcctaaggaactgtatgtattaaagggtcacaaggctaggaaggaaggctagcgggaaacttggcatctaaaggccagcaggaaggtgggcactgttctctgggcattaagagtagagccagagcttagggcaaaaggaaaatggagatgcctctttccctgaccctacactcgctaccactctaggaagaggaaggagggactgtagggagaggagaggaaaaagttgagactacaaaacacctcctccctttagggcaggggcccagcttagttggcagaatcctagcatgcatgcaaacctgactttagcatccagcatcctataaaccggtgtggtggaatgtgcctataatcccagcacttggaaagcggagatggaattatcaggagttcaaggccggtctgggcgacgtgaaactctgtttcaaagacttcactctagatgggtttattttcgaaagcctcagtttaccgaatgatggctgcatcccacgattctgaagctcccgtgactctacacagcacctgtgttttgtgtgaattttgagtttttcctcccgaatggtctgtccagtgctgccaccttccatgttctcagacagatggagacaactgcaaagggggcagggtggggtggggggggaggctttagagggcagaggcacttctccacaggatagatcttttctaggttccagagtctggacaccagagtaagaagggccacctggccctgtgtgcctcaggagctgtgttcccgtgggttctgaggagaagggaatggggcagaaggacccttgggccatccaggcaaggaagaatcagggagtgccctacttaggaatctctctctgactcacagagctgggtcaggcacctgctgcaaggtttgcatagcacctggtatttgtccttaaactttgcttttttgttggggattatgtgtacggagactcacaaaacttgtttctgtacactgaattcccggaagactttcttccccacctccagctccgtttcatgtcaggttgatgttgccactctctgaattaagcaaatattttgctcctgggtttcttgccccacatttgggccaggttgggaagagggtctcaagagtgttactcacactgccttcggggaagcctgcggtggaggtgaggctgtgtaagacatgaatagggtcttctttttcatctgtgtgctgagctggtaaggaaacataggtaggtacctgggattagttctctctccctctgccagggagctggctggtctttgccagccctccttgaactccctctttctgtagctatagcaggaagaccacagagtttcatgcagcatggaagatgggctcaaaagatggcaataaccgtcaatgtgtatacaggcacaaggtagcacttagctgaagttgacttgaggccacctcctggcaagcactgtgtaggcgaggatgaggcatgtccttgggactccagagcacttcctgtgcttagggatccggctagattgtaagctcctgatgggacccggtgtggactccacactctggactacgggatgcagagccaggcaggatgtgcatctttatttgtctcactgttctcagcactgaacatgtgacatgacacaaatgggtacttaggaggcgccgagtgagtcagagaacagatgcatattctgcaatcactcacagatattccatgttagttacatttctcttctgggtggtgattccccttgttgtcggaggcttcttgagctttcagggcatcggatcccttctggaagtcagagtaccgttgttctagaccaccttcaccagaccacgggctttaagaaggcaagactctctcctgaccttaggcattagcagggagtgtgagtgacctgagggtggaactccaaagctaccttatccccatttactggtagcttggcagaatattctggaagtgtctcaagcttgacttgctcagaagaaaggctgttttatgtgcctttttaaagtgtaggatagctgttcccaccagcagacagccttcagctgtatttgatggaaccacaaatttgttttcttctccaccctattcccaccatgaagagacctctgtccagctagccacccgccatccctgaaagaggccaagttcctccttgcactgtactaagtcgaattgcagctacttggatggagggggtgatgttagcccgaacaaaaacatcctgttggagatgaagccatgctgggctttgttacacaatgggaaataggagagcagaggtgagctgcggagtctgactgataattagcttctctgtgcatacccatgtgccagtctgcagccaagctgcctcctaaggggtgcccccttgcctgcccaaatcagccccaaagcctcagaagtcttcttgcttcattgactgccctgttgtgtctggtttttagaaaagaggattgcttcaaggccagaaaaactcagagttctttaatggagcactgggtgcattgaagagaggtggagagtgtcacagagagcctggaggtatatagagctagcccacttgtaggaagccagagttggtagagctccaacattggccacattgcttctgatgggttaaggggcacccttgaaggataggtgctcagtagctgaggtccatcacctgaggtcataatagcagctacctcagaaggtagaaaatgagccaggacagtgaaaaattcagtcttagtgtgtaagcaagagctccaggccatttgtattttgtttgcacaataaacaattattgaatccccattgtctgtttatgtgcagtgttggggtagaaggtaaggagtttccagaaatgagtcagaaccaacaactttgtcttccaaggagtaaatggcctagaagggccccttgctgttgggagggttactgagagccgtgctcaaggtcattcttggctgtaaagaaatgatacccctatttgaaactggaaacatgggtaagatgttattttttttttgttgttttgtttttttttgcaatggaagccttttgttcatacagggtacctaaccccagacctcaggtacacaggctgagaaggttacctctatgagtacacaggcagcactgggctttggaggtgaggagtctggcttatattctgtattcaggtagaaggactgggtggccatgtgaggactgtgaagggaggcagtggagtcatgaacatttctcaaagctgctttccacaagggaaaggaagatgaatattcatgggtctttgacttgtcttttgctttccctagctgaagaataactgtttcatgcattcagctcctgcagtgcagggaggggagtgggaagaaagcagagaagatggtagattctgtgagcagctgaacgacatggtacccatggccttgaagaactgtgtttgagcctctggtcatgttcatgaactatgtacttcctttgaaatttgtgggagcttggcttggtggctgacctttgtttgctatctgctatttattgtagggaggatattttggcttggcttagctagggtgtgagcagcggagccaggagataccaggaaggtggtgggattctcatctcttgaaccctttaccttttgtggccgtagttcttaaaccaagtcagtaggatagcacttgctttactgtgttgtggtctttgaatgtatctggcgtcttcaaggacctactcccttctgttcctccagcttgctttccttatacttctggaagccagcttgttgttgtagctccagcaggcaattcaatgctcaatgcaaacttgactggaaaatacttttgtcccagcattcctggttcaggatctgaggactgttctaattgggttgtctgagaccagggctcacatactgtcctatctcttcagaactttaaggaccccagatggaaagaaggatatataagtgggaaagtaaaaggtgggagcagttgaaccccttatacgtggaggagatttgtaaaccctgtagtgaagaacagctgggaatggggtgactggcctctttatttatacttcacctttaacttgtatcctctttggttgtgtgtgtgtgtgtgtgtatgtatgtatgtatgtgtgtgtgtgtgtgtgtgtgtgtgtgtgtgtgtgagagagagagagagagagagagagagagagagagagagaagtacagtatgtttatctaaaaggatgtggtggctctgtggggctttatcttttgtctgtggttagttttgaattaactcaggttggagtgttgtgcttttttttttttttttttttttttttttttttttccttttgagacagggtttctctgtgtagccctggttgtcctgaaacttgctctgtagatcaggctggccttgaacccagagatctggcatgtgctgccactgccctgagagaaaaatttctttttaaaggacaattcgattgttcacatttgtgttctttctcttagatattggttatgttggctaaatctttagggactatagcttaatataaatagcatcttgcttaatttttattttgaaaaattggttttaaaacttttaagttggcagagctgggtctgagatgactcagtggataaaacacttgctgcacaaacaagaagaccagcgcttgaattcccagaatccatataaaagcttgtgggtgtagtggcccacctattatcccagtagtgggaggtggagtgagtggatcctcggggcaagcaggctaagcagattacctaggagagatcctgtctcagtagctaaggagacaagtggtccaggacaatgcctaacatcaacctctggctgttgtcaccccacacataagcaagcatgaatatatgcacaccagacacacgacacatgcaagacaaatgaaagtgacagataactgtaaatgtctgtcatgtgtagcatgattgttgtgtgccaaaaatgtctatttaccccagataggacactgacaatgagccaaatgaacactccacccaaggctagctcagtgaaccaacaaatttgctggggtacttacaggaccacaggtgaggagctatttccaggagcacacatgcctcagaggcagctgtatcactgaaaagcctatcccagcgtggggtgtcactctgcatccctggatgcagaacatctccctgcagaagttgcaaggtgcccaggcttgtggaagagaggcagagaagaaaacatgactgtgagctatggagaggtagagcagcacctgttggtcatcagttggccttcattggctagagccatacagatactgtgaaatgtttcccaggcgactgggtaccactttcctttccctgctgtgaccagtggccataggcatcagtaccttaacacagtgtgattgccggggcatggtgttgtatacaagaaatccagccactcaagaagctgaggcaagaggattgcaagttcaaggctagcctgggtgattaatgagacccgtttcaaaataaaaataaagagctgagagagtagtctggtcaagtactttacatggcttgtctaagaccctcggttcccttcagtaaagaaaagagaatatttcccattcctacagttcaagaggtcagagttttaagtgggttccactggtccaaggtcaaggtatctgaagggaggatctccttaccttgtgtcttcttgtctccatgcctctttctcttacctttgaatcacatggctcaagtctccacgtccatcctagcttctcccacttcctcgtctaggccagatctataactacaggtagagtcccctgcgcaaccagactgatctcaaatcaagatcactgggacatatcaaacagtatcttgtgccatgtaaggcaacagtcataggtctggactgtgttaatgggcctttctgttgaggtaacaacatatggaactcacacaacttaaaagaggaaaaacttatattgactcatggttgtaagggtgtcaggtcatcatggtggagcctcgtggccaggaaagggaagagaaatgagaactaatgtgaagggacctgtgtaatccagcttcctcctgtttcacccttctattccctggggactcccagcttgttggaaggtgctagctccatccataggtgcactcactaagcttctgtgtatcactcagcacaataaagttgataatcaggattaatttagattaggaagtgggctttagcggaaccagggtccagtacactcctgggtatacatgaatgtccttgtgaagatacagagcgggtgaaggaatcaggaagccagttccatggtacagcccaccaccctccagagtcgcttctcttcacacactcacacccagcgggcctagcaggcttcttcagggtctgcctagcttttcacccatacccctttccaacgtggctctcattcctcaccccatggttgtcctttttgccattttgtcagttctagcagataaactctactaagtaatttgacaaaggtcacctaacagctgcattacccactgagctggttaggtgagtctgacctgtggtgcttcctgggactgaatggaacccaccaaactatggctctgaggatctgtgaatatcacttttctcagaggcttttgccactgatcgggtgtcacagaggacagttgtcaagagtaggctgtttaacataaaccccagataggtcttcctgcttccaacaagaagggctctgtgttatccaaggagacccagaggtggggcaatactgtgctttctgtcactataacaaatacatgagataatcagcgtacaaagggaaggtttatcttggctcgtgatcattgaggtttctgtttgtggtcaattggctccattgttttgagcctgtgttgggtacacggtggcaggaacttttggttagtaaaactcatctcatcacatccagggagtaaacaggagtgaggaggtttgtgggtcctctgatcttcttcaaagataccctctaatgactaaagatctacaggattccaccttttaaagacactattcgttccggatagtatcactctgagattcaagcttctatcttgtggacctttggaggacactcatgatccaaactctactatactaattatccttggaggcgggtcactgtggatgcaaacttgtctttttagggtgcatcgggtaccttctaagggtaggtgaggttgctgctgtaggcctgggtctttctctggagaacgtacttgtatatcacttctctatctctgtcttgtaaagaagtgtgatggaattctggtgggcctggatgacccccatgcttgaagtcgacctggcctttcaacacctatgaagagacctagggagagagggccagggccattagtgatctatgctcagagtggaaatactctatagatcattgctgtgatcactgcagagggactggaagatgaaagtgcagcagggtgacagcttatctgtccctcactggggaagaggaatatgggctcaaccccagctcagtggtttatagctgaccgatactgtgaagttctgatgtcttgttttgtgttatgtgcgtgagtacttgccaactttgggcgttatccctcaggtgccatacaacttgtttttgaagacagggtctctcattgacttggggattgcaaattaacccaggctggctagctgtgaagccgagggatctgcctgtctgaatcttcctaacactaagatgacagacacactccaccgtgttctggggattgaacataggtccccctgcttccaaggtaagcaccgtaccaaatgaaccgtcctccagaatctatgaatctcagttccctatagagagcagtctttttttttccttttctttctctctttctttatttttttaatattttttattacatattttcctcaattacatttccaatgctatcccaaaagtcccccataccctccccccaactcccctacccacccactcccattttttggccctggcgttcccctgtattggggcatatacagtttgcgtgtccaatgggcctctctttccagtgatggccgactaagccatcttttgatacatatgcagctagagtcaagagctctggggtactggttagttcataatgttgttccacctatagggttgcagattcctttagctccttgggtactttctctagctcctccattgggggccctgtgatccatccaatagctgactgtgagcatccacttctgtgtttgctaggccctggcatagtctcacaagagacagctacatctgggtcctttcaacaaaatcttgctagtgtatgcaatggtgtcagcgtttggaagctgattatgggatggatctctggatatggcagtctttagatggtccatgctttcgtcacagctccaaactttgtctctgtaactccttccatgggtgtttatcatagcaacatttggtccatgcagtgatgcaagaagggcataagaagtttggaaaccctctctgaaggtgagctgcttccctgcccatcgccacttgcgagccagccccagcatttgtggagcttggtctggagtggagagaaggtctgcagaaagtggaggagaagctggtgcctatttccatacttcagctagagctggagtatgggaggctgctctgggctggcatcctattgagacactgcttggactgtcttagcctcagaaggaggtttaccaggagatctggatgtcctgtgtttggaagatactgggctgaggccagggacgtctctgagtcccattgagtaccctgatgtcccatcctccaacctcctcaggaacctgggggcagagcacagctgggctttagtatcctggcctggatcccagctacttcctagttgtgtggctcctcaggatcttactttcctcatctgtgaatgggaatgaggtccaacctgctgggacacttatagggaataggaaggaattatgaaggggacattttatagcccttcctatcagaaggcatggtgccagttctctcctgttttcctcttggccttcctgagagctgtctcctgtgcctggccagcgttcaataagaaaacccttcttgccaggtggctttggagggcctctcagtcctgtgcccttgggttgtaactgggcagggtctctcagttggggaacagaactgtttccagagttcacagagtggcagacagtgcagcaacctgcggaggtatctgctgctagagcagcagtttatggccatcctggagttcttggcgtcagggctgttttatggggctctgtgttcttggaaccacacccaagatttcccagttcctttataggctgcagtgccataaggtgggcatctgagacacctgccaaatgcgaggtggtggtgaggtgatgatggggagatctggtgccaggtgagaatcaggtggctcaaaggaaagccatgcctttctagtcgcccacttcccatctgctagtcttgaggaagggaacaacttgtctgagctctggcataagttactatcagggtcagagggagagacttcatcagtttttaccatgcctctggattacttttcattatcatttacactgcccaacaaggaaagcctcccatgctactatggagttttgcaagtgatgacctcatgtaggctagtagtgaccagctctaacctacagctgaaaaaatactggttcaaatcctgtcctcactgtctaactgcttttttgtggggaacatatatgtgttcaagtgtgtgtgtgtgtgtgtgtgtgtgtgtgtattgttccttagtaacctttgttttccagacagggcttctcactgacctggagtttactgagtaggctaggctggccaggcagagagccacatagagcagcctgtgtccatttcctctgtgctgggatttcaagcgcacaggacaatgcttggctaattaattaattaattaattaatgatgtggctttaggggactgaatgcaggcttctgtggcaacacctttaccaaaacatcttgccaattccttcaactggttttattgttgttacctagagtccagggtgagtctatgtcttgccatgcaagaagtggctgggtgaattgctagctggccttgtattaaagctgcttttctggacaacatgctattagcagatccccagtaatactaggcagtgatcacatgtctttttggtcttcccataatggccccacaaggttgtgggtctctcattattagtgaaagaactgcatttaagaagcttgtccaaagtcattcatcaagaaagaggcagaggcaggatttgaactcaggaagcccaatcctcagtcaccaagagctgtgtttgtcacttaagtctgtccttgacccagaagaccaccacttactgtcacaacacaagactcttgtgttggggcaagtatggagtcaggacctaaggaaaggactccactgttttgttgtgacttggtctggatgtgaggtcagactctaaagagggtgtggggtatctctttccctttcatccagctcttcacacatgcttagaccctgttctacaggactgctgtccttgtttcacatttgaatcttcatcctctggccacatccacactgtaggatctcagagggaagtctttccagtctcatgactgtatatacatctccaccagaccctttcctagcagtactctttgatggtggaggcaggaagccagaggggaaagaagaagaagaagaagaagaagaagaagaagaagaagaagaagaagaagaagaagaagaagaagaagaagaagaagaagaagaagaagaagaagaagaagaaagaagaagaagaggaggaggaggaggaggaggaggaggagggagggannnnnnnnnnnnnnnnnnnncctgagaactctgccattgcaaataccattacttgttgctttatttttagcaatatgagggtcccggagggcaacaggggatgtgggaatcctattttttgctccatcttgctaatggaacctctagcagtttttatgcttgatttactttcctctgtagttggccatgcctgcagccctgaagcaactgctcttccccttcgtcaaggaggagcagagtggatgatgttgagcactggccttgtagtctctctctctctctctctctctctctctctctctctctgtctctctcttgtctgtctgtctctctctctctctctccctcctggctcgagtttctctgagcaggcagatggcatcattcctggttttctccccttagatctggtaaattctggttgcccaaagcataatcatctccctgctaggatgaatggccattctttggagatattctgggcaaaggcaggttgatgggggggggggatcgctggccccacagtggaggaaatgggatccagtgcagggatgacagtgagaaagtgtggagcaggaaagtatcttctggttgtctatcctcacatcttgccaattataaaaagcagtcactctatagagacattaactatatgctataaagctcatgtagactgtgtagccaccattatccaattgtggaccatgttaatcgtcccccttccccaacaacaatcacttcacattccctcttacctccaaatacagttgccaatcgtcttctagtctaccatttgctttgtgggaacctcatatgaatggtgtcacatgttatgtggcctccttggtgctccaacttatgctataatagtgagccctgtcactgaacataggtgtcagtagcagacaatagagctactaggacctgaaaagctgatgacttcctcaacttggctgttgaactggggtgggaggagcagatatgatatcaggcattggtggttacatgtgcctcacaagttggggtaaagttagaaaattcttcccgtccctcaagagggtaggaaatgtatcaagggtacattgttctcagaacactgtggtgtggggtcattttgatgtcaaactaggttagtatttgaggtggcctggatcttgcagacaaagagacagaggctgcattcttattgcctgtgttgcttagccctcaccattgcttggatcgaatcattagcatcgtctatggcacctgctttggtgctggttcaagtaatttgcttcctctctggtctagtccatatccttgaagaccatggctttgaggtccacatggtttctggttgagtcacagacaaataaacttcgtgggacgaggaggcaccatggtgatgacctccaataatcagatcattgagattaggctgtggcctctcaagtccccgtgactcctcttttggaaccagagaagaaattactttatcctggggctgatgggaataagtagtgcatggatattttggtgcccagatattttaaaaattttattagatattttctttatttacatttcaaatgctatcctgaaagttccctataccctcccccaccctgctccactacctacccactcccacttcttggccctggcattcccctgtactgaggcatataaagtttgatagaccaaggggcctctcttctcaatgagggctgactaggccatcttctgatacatatgcagctagagacacgagttctgggggtactggttagttcatattgttccacctatagggttgcagaccccttcagctccttgggtattttctctagctcctccattgggggccctgtgttccatcttatagatgactgtgatgtgagcatccacttctgtgtttgccaggcactggcatagcctcatacgagacagctataccagggtcccttcagcaaaatcttgctggcatatgcaatagtgtctgcgtttggtggctgattatggtgcccagatttttaaaggagaaaaaaagtccattccaggtgtccccacctaaggtaacgtaccagagtgtgtatgcggaagtcagaggacagcttgcagagaatcggttctctccttacaccgttaggatctcagaaaccaagctcaggtcttcaggcttggtggcaagtgcctttttactagctgtgctgtctcgtcagtctgaatctttgcctttaaatgacacagttagatggtcttcctttttacccagagggctctggaatgcattgagatggtattgggtggctgctgttgctggatgtgagttattggtccagtgtgggacttgggatagaaccttcaatagtgatcttccaaggtatcccagtctcttaaaggtgtgaggctgcactgggctcctgggctcccatttctaatggtgttttggaaggtggagagggctggttgtgaaagccttccctgtcaggcttcactgtgtgtgagggcagggatgaagtctgggctttgctttgcagatgaaaattgcctttgctcagtgggaggcacctttgaccacatcagtctggggagagccattaagcccccattatgtagctgctgctgtagtaagcagattgacaaacagtttgatgtcctgtagcctgagaggccaagagctagagtggagtgggtgtaatgattggggtctgaggtccttgatatcacctgggttctgtcacctactgactccaggaccttgaacaaggctgtttaactctgtgttttgtaagaagctagtgtgtctacaagggcagttttgaggactgaaggagtgtcaggttcttaaggatgctaaatcaggccttgtctgccttcttcccctccccctccccttcctcttctccaccccatctctttccttcttcctcttcctctccctcctattctttttgtttggcctcactgccaccattaaacagctgaggatagtttaggccatctttgtcaactgtaaagatctctttgtggcagcatccaggaggcagtgcccacccctctagaagtaaccaggagtcagagtaaccccttctgctccagagaaaatgatgccatcaattgctttccatggtacaagtccaggctatgaggatgggttgacagtgatctacatctagacttggtgttccaaccacatgcttggtggcctatggagttttaggggatgatgaaagtttaggatggaaagaaacaaggcaaaacagagatttgtgtagtgggagaggaagggtgcatatggaggcctctggtgactaagggaggggtggcagtttgcgctgggttacagggcttgctcagcaggacactgaaagccaacatttggctcatggtatcccattattttctacagctctaccaacccagatgaagggagtctacccatgtgctgatctccctaactgttgaaaacacgaggaatggtattaaagggttgcagcatcaggaaggttgagaacagctgtcatggaggaagagaatacctccttaaggacatgccctcttcccccagtgatctatcttccttctgttcaccacccaatatcacacaaactgggaactgagcctttaacacaaggactttcaggggacaccaggatccaaactgtagcacattccactctaattaagaataaaacagtgcccagtatcacctctcgttcaacaatgaactgtaggtctgaaccagtgcaataagataagagttgagcaggagaggcatacacattggaaaggaagatataagggtgtcttcactggctgctgatctggtcatgtggctggaggaaagcctagactccaaatctataaattattagaagcaaatggagttcagccaggtagccaaaggtcgaatgccagatgcatggcttcctaagagactgaggctttgtgtagagtaggatctggtcattatctaattgggtggcatccaggctatgcttcctgacttgcattggtatggtgggacaaagtgctgtctcactcatatccacccacctggcaatacagatcatgtagtgtgcgcgcgtgcccacatttgcccacacatgcactgtggagatcacaggttgatgttagatgtcttcatcagtggctttccaccttatttttgtgccagggtctcttagtaaagctggaattttagctagcccaggtgggcaatgggtcccaggacctgcttatcctccttcaccccacagctgaaggtacagttatgtgctaatgcgttttgctttttcctgagctgcggaacatttgagctcaggtcctcacgattgtgtaggcaagcattttaccgactaagccatctccagagtctgtttaattcacttaattgtttatttagtttttgagatagtgtctcactatttagccttgcctggcctggaacttactatgttgaccaggccagcatggattttgttgctttgtctgtctccaacccctggatattggaattacaggtgcatgacataaggcctagaagagacagttttagttttacagaggaaggacctgtgttctacagtggttacagtgaccttgcccaaggtcagttggtaaagaggcacagctgtggcccttctgtctactctctctcccagccctttgcagacctgacaggttctagcagagtcttgtcctacccgttctttgggctccatttccaggactaatcaagatggtaggaggatagtctaggcgcatttcttttagaactgacatattctctgagatttcttttgggaacacagcagccagactctgctgttaaagtgggctgcgtctcatgctgagaagctaggcctacttttctctgaaaacactgggcttgaggtgctgaggtctgagctcttcattcgtcagcccatgttcctcctctgcctcttcttactcctgtttatactttgctttctcatgcctcctgtacagtcagggaagttggtaagccataatattaatacgttgtagccttatttcatctttggtggctcctggaggccatatccctccttccctaaggggaccctctgttagagtcttccattcatttcctcaggcttgagatagttctgccggcttgccattcagccagcgagagtcgttgaatgccacccgctctgtgctaggtgctggggattctgtagagagtaagataggcacaggtcccttcccttacagtgctgacagtccggagggcaaaagcagcattcagcagagggtctaacatgctagtgagtgctttagagaaaaaccaaggaggagaagacacccttattttctttacatgtatgtatgtatgtacgtatgtatgtatgtatgtatgtatgtatttaactactgtgtgtgtatgtgtgtgtttaagggggaggtcacaaagtgtgtgctgtgagtgtgtagaggtcagagaacaatatgaatttctttccttctactacctgggttctaggatcttcctcagacttgaaggccaaatgctgagccatcttactccctcttttaatttgagttgggcatttaagggtgggaatccccgaggtaggttcttatggagacaaaaggacaggcagagggaaagccacacagatctctgggaaaggagtcttggggtcagtgccaaggtcaggaggcaggatgatatctggtcaagactggtcccctggagcagaatcaagaaagcagagacaaggacagatgagaaaaaacagtaggaatgaaggcttagaggaggagggattggaggagggcaatcgtgtttcttatttaattgtactgggctctctattcctcccaacaaccacagaatcttcacggggcaagagcaccagccctcactcccctttcagtggactctcagtggttggttgcagggtggcctccgtttcccacaaaggcaatgctgggacctgaacagcctgctggtacgtgccttcccacctggtaccttcttttggagaggcacttctaagttgaaaggtgggtgtttcttctaattctaacagatactgcaaaatttctcccttgaaaggttgctgctgaattggggatcaacttctgtttgtgagctcagctgcctgcctctgcttctagattgctaactagccagtctgtgctgagggatgttctgagggacggctcagaatccttcatctgcgggaaggtgtgtgtggtctttcgaagcatgctgctggggatgacatggcttgttcatttttggagcttgtatttactgactgtgacgtcaggacagtgaggaagagggaaacacagctgttgccgtgttgtctgcattacggctaatgttccatgtgcttaaaataagcacagcagtgaggaagttcatggagacacattcgcaccttgtcagatactgaatcatgttcctggagtgtcttcagggtaaggctgccttgcagcatcctgactggagggcctgtgaatgctgagcgcctgctgactccttccccacccctgggtgttgcagaaccagctcttgtagacttttcatctgtttgatgtcctcctgtggctgttttccatctgttgcagttcaaacaatgattaatcttgcacatgagtcctttcgcacatgcaccaggttacgtgttgggtcaatttctaggagatgagtagactaaactgaaagtgattttctggttatatgctgatagacatgactaaattgaccttcagagaggtgtccctattggcagctggtacaaatgattatcatctccctacactacataaaacttgggaggccgtccatcattataatgtttgtcaatctgataagtgagatgcctgctgtgtgtcatttcattttgcattggttctgtatgtccttttccaatgtcccaagcaatataggggctgagggtatacctcagtggtcgaatgcttgttgagcatgcatgaagccttgggttctacccttatattccccaaataacaacaacaaaacattttaaaatctgtttctgttttctagtgtgagctgccaagtctttgttatcccccccctccccccccgttaatgttctctttctgactccttgaagaatggcttgctaatgttagaggggtattcgacagtgtgatcatgaacgctggcttgtctgacaagaagtcagtagctaggagtgaaagtctggttgtttgagaaaatgagacctggtaaactgtaggtctgaagtatgcttctgtatagtgtagactaatcatcagagaggctaaaagcagacagagtagggaactgttggcctctggatccatgtacctgggtttgtctttcacagagtctcattttttatgcctttaccggcttgaggaagtgtgaggaagcctgactgttttctatgaaaatccttttcttgtttgattggattcataattacactttgttttctggcaaccactcctgttgagttaatgggttaggccaggtgacacaatggctttagtgaatgatccttaacttcaggaacaaaacatgataagagagtggatgccaccttcttaacaccatttattcttactagagtagatgctcctggcggggcattcttcaagcatctagtggaggatgcaggctcctgctgtccggagatctgccctgtctaggtctctagtacacttagggtccttgtctgtaggaaggaaaagagagaggtggtctctctctctctctctctctctctctctctgtgtgtgtgtgtgtgtatgtgtgtgtgtacagtcatagctccatagcccccaggccaggaccatgatccacctgccagaggagtggagtccactgttgtgtctggccatcagtcttgaccccaggcacacagtctgccctggtgttttagtgtctatgtggcacttagaaattttttagtgtctcttccagtatggttgcactatgccctcacagttctgcacagaggtaacataagtgctttcaactctatttggaaccctggagacagatgtctgggagacacttatcctatgggaagctcgatgcttaactacccacaccagcttagtggccaagcattctcactgactggccttttctggtatgacagtcagtggccatccactttaggtctgcctggacagacaggctctgttgatggtgagtgagggagaactgggctgcctacggatgggaaactgtaggctggctggagcatatttcctatccttgagggagacaagagtggaactagtctcgtgtcctttacaaagagcagccaaatggtggaaggtgacagagttactactggtgggaaggcttggccaacttgtcctatcacggtgtgacagaacagcttgaaacctggcatctttgtggggagctggtcccctcatccatacttggtcatccttcttttcttgtcatttatgtggggtactagcactgaaatcggggcttttccttcacactcttgtttctctttattttgttattttttgagacatctcatgctgcaagagttcagctgtggtgtctcatcggttctattttgagccacagggaagcaaatttagggtgttttcatctcttctctgaggggatggtgctcccaggggtccactggatggacagtgtgagacagcttaggcactctttggatgcctacctttctgatgaaggagcacacttcttgttttccctgtgtgaattagcctggccaaatcctgtcaagacagagcgatggatggtatcatgagtgttatgggctattatgatagcaagatggcaccaggcatgtcatgacccatgttctggggctaaatagtggcactggtaatcaaatgtctgtccaacttagctttctttttgtacaagagaaatgacatagttcccgctgctctcacaggatgcttatgaagattacatgagataatgtgtataaaagtgcagtataaatggaaattcaattcaaggtattattatattaatagtaatgattgtcatctgtgatcccaatgactcacttggggtgggagtccttggagcttgtcatggccactgttacctttcagctacaattaccatgcgcaatttcatttgacatactcctcatcatatgatgccagaatgggaatgggtcttggggtgaacgaattgtagcctgttgctttatagatggggagctgctacccagcagagggagattggttaaggcctttagacaaggtttgaggctgtcagctctcagtagtgggctgttttgttttcagattacattgtcctatctttactaaaggtctagaaattgaaaactttgggtagaatgtttatcctttgtcacttgatggagttgcagcctgactcatgaggttctggagaaaggtgtggattgtgcccaggagagaagctcagatgctgagaatactgggccataggatctaaaagagataaaagaaggaacgtgagggatttctggaaagaagagacctaggttggttccaaacaaagaaggaggaaatgctttgctcctgaccttgctagactcctgtcttcttcatatattatctctgtcttttctagaggctccatacacatgtgacacagcttagcactgtggggttccatacaaagagagcactgatgagaacccagcattagttcagaatccagcgaaactggcttggcctcattttctaagtctttggttaacacctctgtagagagaacatcttgcatattctatgaatgtgcctatcaattaaaaagccaatggcctatgacttaggcagaaaatagaagatggaacatccaggagcagaaagaattctggcatagagccaggcacaggaagacttgcctggaaagatgtgagaagacatatgcctggtacctgagcacaggtaaccagccacatggcagaatgtagattaaaataaatgggttatcttaagttatgattctaggtagagaagagcctagctatatgatctaggtatttgtaaatacattttgagtctgagtcttatttctgggcacaggggtctgggaggatgaaccagacttaacttttacacacctctcctggctcaaggtcttgctcatatgctagatgaggcatccccctgcttaaagacacaatttgtaacagctctttctccttgattactgcttccttcagtggattcatcatctagaattttatcccccaaagttaccaattttagtacagacatctggtataccctttggccagctttccttaaagttcatatcttatgcaactgtggagcctgacagtgctggaaccaaggatttcacattggtgttaaattgttcaccaaagccagagttctgttgtctgtagcttcctcacaaatgcctttcccaggatccattccaggaccccatgcaacatccacctgccatgtctcccgagcctcctcccacccattttttttttcttttttcatgactttgacatttgccaagaatattgcttagcttgtttcatagaatgcccctgggtgtgtctcttaacttttattcagttggtataatttaattggcataaattggtataatttaattttattttcagttggtatagaaaataatggatttcaccatcacattttaatacatgtatggcattgtgttttttgtttttttggtttttttttgctgcatctagttacttcttatagttcatattgtggcttgtcaagagtattggttaggtttttttttttttttttgatagaatgtccttcagtatgggtttgttttatatctttacaaaagtttttactagtgtccaaaaacgagttccataaaaccttttcatacatgtctttctgtgatttactcctgtctagtatctttgtacagttgatgcgtatgaatttaatcatgtctattgggtcttttgctaatgggaatgtcatcaccttcagagtaaggatcttgtctttctggtttgttcatgttcacgaacatctgtgtgcctggcacccacgtcagtcaatatttgctgagtgactgtggaggcagtgaactcctgatgctggtggactgtctgctcaaggaagaagaaaccctggcaaaagccatatgaacaacaagacctctgggaactgctccccctactcttactatgtgtgggcccaagtattgtatttcactacatccggtgtgttggtggagtatgagctcacagtgaccactcgccccagacaagctgaggtatggatatgtacctgagagccaggctaggctatgtacttactccctgggagctggcaacatggagacatgctgagaagcacctgtatccagttgctaatccagacctaggacctcatttagccttcctgaaagcccccagcctgctttggaatggtaagagaatattgttaaaacatagatttctgggacccagtgttcgaatgcatactttgtgtgtactgggggctgagaaattgcattcccagtgacttcccagtgatgctaatgctgttggcccagtggccccgcctaagtacagatacatactctaactgttcagaggaaacaataggttaccaccaatcagcaggatccatgaagtcttcctggaggaagaggttaagcttgagtcgtgtctttggatttcattgctgtgaagagacaccatgaccaaggcaactcttataaaggacaacatttaattgtggctggcatatagtttaagaggttccgtccattatcatcatggcagaaagcatccaggcagacatggtacttcaggaggggactgagagttcaatatcttgctctgaaggcagccagaagattgtcttcccaggtagccaagaggaggctctgaaatcccactctccaaatcccaaaaggagatctagtactcaaagttctatccccacagtgacacacttcctccaacaaggccacacctactaatagtgcccctccccatggctcaagcattcaaatacatgagttgatggggccattcctattcaaaccatcacaagtagggggaaatggactgtagacctgtgtgcagcagcttgctgctgttgtatgacctctgcatgtcttttgtcttctctttccctgatggcatctgccctcacttgaggccttatccaacactcccatactgtgagccacctgagccaggagactatgatccacccccccttcctcacccccagaaaaggaggctgactaaggctctgattaaaattgaccttggctggggtcattgaagtcactctgagtcctggatgtatcctttattttttatggcttgctttaacgtgtttatttgcccacgcctggtccctgcccattggctctgatagaggtggtgctgttgggctctctgactagttctgtttccatggctggcaccagcactatggggcagatgaggcgtgtggccacgcttgcttctctaaaggtgaacatttgagtttcactagtgccctgtatggaaaccgatggatccatttcaggatacagaagctccatggaggctggagaaaatatttacaaggataagtccttaagtgatggtgatgcttgcatgtgagggtgtttaacttcccatcagacgggaagagagagaggcgtaattaggggaaagcagcatctggaagcactagagccacattgttctattggaagattctggggcagaagatgatatgtcatccaaatcacaggatgactggtcccctactgagactttcttctccactgttttctatactctattaaccccaatggaccctacttatgatttgccttgatggatcgatatgaatgcctgtttcaccttaaatgaataacacttaacagctacttgtaaggactcaaatactgtagtattttatgttaatttcaaatcctccagactccttattaaaaatttaggggtccagattccagactcaggatgatgagacttctctttattttttaaaaaattttaaagcatattcctaaaatgcaattctgatcagagtttgatgagtactaacttaagagtgctcacagcattacttttctttccaatcggactatttgttgtgtctccagataaactctaaacattttgcacaggtagatcttccttctttataaagtagcgcatctgtacgcacataagggcaacacagggtgattaatattgtatgtagtgggaacctagaaagtgcttgttgaaggacacatgttaggaagtctctgtaaaaccaggacttattagtgaggctggtccgatgattgccttccatcaattgtactaaacaggtactcactgctgatcgcccaggagcctagagcccaggcacagagagtccacttgctgagattcccaaaccagcagaccctggcatgctggcgctgttctcactactttgatctgtaagcttatgaaacaaacttctccctctctccgccccaggctggttctaagcacacaaagccatagaagtgcatgctgcagaacagagtgtgtttggaccattcagacatagtagcgtggttagctacttgtctacgtggtagcttgtgtaatgacttttgtttcctcgcttaaaatttgcagcgaagagtacatatgtttcatgtctatctaagagtcacacctcctgtttacacaggcctgttctgggagacctcagaggcttctcgctcgctgcggagtgttatggcgcaaccttggcattgagtctctaagcaaaagaggctgcttgaacctcacgtggcagagggcagcagtccagaaaacacaagctcaaatggtactctgtttggaaacatcatgcaaggttgtttagaacgtgccatgtcgtcattttattaagcagggggaagacagaataataaaagcagatggaataaaaacagagttaggagtcaaaagtgtaggctaatataaggaatactgtctcctttcttcaacaatccagccatccaaatagaggcacgtgcttgcactttggccagttaaattcccgtgacaggtacatgaaagttttaatctgctgtttcatgcgcgttgttgggtatggggagaacattgcagatactggagctcactttcctccacccctgtgattccactgcattaatattatgtttaattaatctaatttattatattgacttttttgcttaacttaaaaaatgagatggattattagcttcttaataaacaataatagtcaacagctactagtaaggactcaaatcatttaattcatcatcatatctctattttgttgatgaggtgggacagaaattgttacttatcagaagttggacttcttgaccttcctgtaaatgggatggcagagtgtggtccatgctggatccaggatatctttcaagtagagcatcagaggaggctgtccaacatgcagcaatagcctgcagctttgctgtgtctagtctgtgatccttggatccgtgggtgtgctgagagctcagtagagtgaccatgtgaacctgtgtggggattgaaggccacacagtcccactgtgatgactgtgcaatgtaatgattttccattagatccagatggagagcactgtgtgctgacttcagctgggtgagcactgggcccctgttaaatggagaagctagaaaatgtgtgttgagaagcatgctgcttggctttcacagtgccacacatgtccaccttcagattgacttctgaccttgaaaaccttgaggttcctgaaggccattctgagatatgtgctatgagaagtgagttttaggggggctttggagtatgtctttgcaggaacatcattgccaggcactaatcattctctcacttggcactgaggaaagcaagcaagcatgagacctggccactgacttgcagtgtggtggggcatgtaatacacctgcgcagaaggctgcagaaagaggagtataggcccaggttcctgaatgccaaaaccaaccacccaatctacctatcctcaaacactacaggaaagcagtcctgggtgagccaaatccaggagcctgtaattctccttagaggatagctgcgctcagcctggaaatgtgtgtggacatagttttacaaacagcgatggacgaggggatggaaacagaacatgctgggtaccgtgaagaacacaggcaagtcaggttaatgcacatcttaaaaagttaaataattatatcattaactccatgacaattctacccagtgagttatgattatacccacacctccccaactcccgcccccaattcctcctccacctcccatccaatgtcatgtcttcccacctttaaaagagaatgaaaacagaaacgaaaacacacaaaccaaacacacacacacacacacacacacacacacacacacacacacacacacacaaaccaatcagttgagtttactttgtcatggctgactactctggggtgtggggcctgcctggagtgtgactgaaattccaggtctcactccagtgaagaaagctaacattccctgtcccatcagcaatcagatgacactgtcttctctgcaaggcaccacatcactcccacctgtcttcctccatgctgggacttttgtctggcttgagtttgtgcagcttttgtggtgagagaggatcatcagggctcacagacgcaagctcttattcgcaggttcgatggctggcacaggtcactgggattagagaggtgggtggtgagacccactctgcctttgatccagctaccgacacacactgagcgttgctattgactgacatcatttttcttaccctaggtcgtttgcttccaaggttacacacaagtcttttctttaaatattttttatgaggtattatcttcatttacatttcaaatgctatccccaaagtcccccataccctccccccacacttccctacccacccactcccacttcttggccttggtgttcccctgtactgaggcatataaagtttgcaagaccaaggggcctcttttcccaatgatgaccgactaggccatcttctgctacatatgcagctagagacacaagctctgggggtactggttagttcatactccttgggtttttataagtgagctaagcaattgaagaaaccaacagatatttacgaaatgaggttcttggtgaagcatgataaagcatgacattaaatcagaacatggagacttctcagcctactccatagatccagcctccggcattaaaacctgtgtgttagaaaagaaacgcctatttgatctacatagggtcacgttcctatcaggaaatcatgtctccctgggtggagaccattgtctctctgttgagccagcccagaggctggagttagaaggagaataacaggcaaggatggttgcccgtggagtagctccatagccatgagcaatcaaccatacatgtatctccatgtgctgtgccacagtccaaggacattatgcaaagggggacctgggatctttgctttgcttgtcttcccaagtcaagaagttcacaaaccaattttctgcttctggactctggagctggtcaccactgtacttatattagagatcttagaagaggacagcagcctaggatctcatggccaaaatattattataatgtttaaaaattatcttttcttgggataaaacattcctgggttacaacctggacttcactactatctgcctctgaaatagtattccgtgagacatgggactgtccagtgtgtgcctgccaggacctggattccactggccatgcatgcccccatccatctttctgctcaactgaaatagcgagtcattgacctcatttttggtgaacctcagctgcttactgtgggatctgctgaggtgaggtcagaatggagctgcccaggggaagcttagcctgcaagtccatggaatagaagcaaaggtcacagccagggaggagctggaagaatgtgaagtccaagttttgggtggtctcaagacaggccttgctcatgagcttggtggtgcctttggccatgatggttctgagactataagtggtgtaggtcgccaacatgaaactggggtcccgtggtgttgggagactgaagcaggatggttagaaggttctgggacaactttatcttgccagagccaacttcgccctgaacattggcacttgggtttagtggtaggagtgagtgaggagaagcagggcagagtggattgtcttcaggaacatcctagttagggggggtacttgagaggactgaggaagaacagggctgcttgcttgtcccagtaccttccgagggcagtgatttgggggcatagtaaggttgggattacttcctggtttagatacttttattttaagaccctacttggtgcttatagatggtgctgtatattagacaatttctcagctttttttatatacacgcactttttaatgcatcataataatcctataagacaggtattgtctgtcagttataggggaagaaacagatcatgcagaagtcaataaacatattcaaggtaacttagtcaaatcaagactcaaacccaggctgactagctccagggccagtgtcctgggcttgatggtagcaatgacatcattggtgattttgggtgcagactctgctttagccctggtgggtccaaggtacagatacatttcctttgatcttgctggagaaatttccagttttctcagcacttggaaaataggagatatggaacttcagagctatgtcctgagggcatatctcctggtttgtggaatttttaaaagaggttttattctgcagcaggctttcttgtccagagatcagaggtgaagggcagcttgccacagcattggctcctcgttttgctttctctctcatcctggaactcagatactgtttgaagtttctcttgatctgttagggatagaggtgtctacacttagagaggaaggtaggtctggacatgcatctttcagaggccatgccctaagtagcagttctctggagcatctttggactatatggagattatgtgcggaagggcaaactccaagaagaaggcaagcataaggagacaatggaccatgaaggctagattggcccaggacatgccatctttgtcttgcctgggttagaagtatagatttgggtgttgtattagtcagggttctctagagtcacagaacttatggatagtttctatatagtaaaggaatttattgatgacttacagtctgcagcccaattcccaacaatggttcagtagtagctgtgaatggaagtccaaggatctagcagttactcagtctcacacggcaagcaggcgaaggagcaagagccagcctcccttcttccaatgtccttatattgtctccagcagaagctgtagcccagattaaaggtgtgttccaccacacctttaatcccagatgaaaggtgtagcccaaattaaaggtgtgttctatcacctttaatcccggatgaccttgaactcagagatttaatcttctggaatccatagccactatgcctcaagatctccataccaagatccagatcagaaacttctatctccaagcctccagataagggtcactggtgggccttccaattctggattgtagttcattccaaatatagtcaagttgacaaccaggaatagccactacaggtgtcaaatagattctgctatctgacctggcattgccttttagaaggatggaatcaagtaggcccttgaatgtaattgctaatggtgtcatggcttgcaaccaggtactggtatctcgttgcttgggttaactccaatagtactgctgatgagcccagaccaagaacctcttgttgctctctgtaacaaaggatcttgttataataccatagagttttacggttagtctttctcccattcttcaccagagggaactatggccttttactgtggtaactgtatactggggtggcgggtaatgaaagtcagactttttggagtctagtggatactggttctgaattgaagctgtttcaggagactctaagaagcaccgtagcccttcagttaaagtagggacctgtggacgtcaggtgatcaacagagttttggctaaggtctgactcaccgttgttctagtgagttcccagactcagtctgtggttattcctccagtccccaaatgtagaatacttagaagtcagcagaatccatgtgtaatccaaattgcttttctttgagtggagtttgtgggggtcacagcagagtccaaacaggggaccctgggtcaagattcattaagaactatgatgatagccaaagaatactgaatcaaacatgggacttgtatggtgacatgggttgtaccttaagtctcaggaaagccacagtaattgtccagctgcagggtcaggtctaagctttgtcctgtgttcttggttgtttgggatttgggactttctcttcttttgccaaggatagatgcctcgtctgagggagcaaggggcatctcaccaggcccagtccgtactgttcagagacatctgccttcctgggctctgaaagggagctcaggataggctaaacctgccctgcacttactaatctgcagattcggagaagagctagtagagaaaaagtcagctaagcaatatagatggcactgtacaggtcacactgtttgtgctgaagtttttcttgtgaaaagttgatccaggtgtgtggggcgaaggaaaatgatttgtgctgattcactttgccagcaccgaagggctgttatccaactgcgagcttggcatgcgtgttcattttaaatttaccactcatgggagatggtggcttatgattttggcaaaaatggttctgggatacctgctctcaactcacttctgtagtaggagataaaaaccactgcactggggatatctctaggttttatttcctttgctggaatctttccctttacttaggtaaatcattgtaaaatcctccagggagtgataggtggggatgggggtgggtcagggtgggggctggcagaggtagactgactgcctctctctctgtggcccatgagctaagaatggtttatagatcttgaaatggttggggaaagccaaaagaagaaatactattttttgacacatgaacatgagaaattacaatttctgtgtctataaataaagatttattggaacgtggccacacatattcaattttatatcttcatggctgcttttgcaccacagtggcagagttgggtaatcagaagacgtcattatggaaaagttttctgacaccttggctgtgggataacattgtggctccttggcctggcttctgaggccttctgtccctggcactggcctctcttcagccctacctggcttctgtgactctgcaagttccccagggctactagaagctatgaggtccttgggctagcctgccctcttctctgttttttttcttcaacctcttcctgccttggctaaacaccagtgagttatccctgaagcaagctcctccctcttgcccttccctctctttgattaagtggctctcaatccgggtgaagaaaaatagggagacccttagagactctgaaagcttgaaacttggtttggagggagaaggcctggaggctgagatggctcacgtagtcaacagttgggaaccagtgcccggcccctgtcaggtgttctagagatgaggctcagccctggcctctgtgtctagttcacatttcagtggggggagaggcagtgtgcaccagtattagcatcaggccggcacacaagaagtgatgggggagtgccatctagatatccacagaggtcaatgaggtgaccctgagccccagtgaactagggctctgggttggccagaactctcggagagaggggcaaggtgtagcacctatatgtttctgcttccgttttttatggagatggctggagggtggcctgtctttactgctggagcccagggtatcctctagtctgtccttgcttgtctgtggtcaggctgttcatttcctcaacccttctctggatccttttgatctttcatccccatccacaggatttactctgaggtccaaagtttattttttattttttcaacttttgaattgtttttaatctttaaaaattattattctttctcagttccatatgtatgtgcatatatatatatgcatatatattaatgtgtccatttttacctctcccatcacccccttttattcctttttctcttttactgaaagtctccctaacaagctttacctcctttaatatctttctatgtgacccactgcatttactaacaattctggttgttctcatgatcaagggtgggggttatttactatagtttgggtaacttatcgacaacatcactaaactgttcttttccccagaaactgttcataggctctgagggagggatggggccccccaaatcccttccctgtgcatgatgggattttgacagtcccaatcttctgcaggttaccataggtgcagtgagttcctgagtctaacagccatgtcacatctagaagatacctttccagagctgcctatcccagctcttacatcttctccttcctgctcttcctcaatgttctctgggactcaaggtggggtgttgatatagatgtctcgtttagggcccagaactcaatagtcacttggtcttagtacattgaccagttgtaggtctctgaattaacagctgctcattacagacagaacctgtactagtgaagactgagagcagcactgatctatagatatgaacatagggagtcagagaactctgataacatgtccattgaggaaaacccactatgggctctctcttaggacatccccagccacagagtttgacaaggttttacagtatcaggtttaagcgccctcctattgaataagccttaagtccaaacaggaaatcgttggttgtctctgttaatgatagtcataccactgttgtaagactgggcatatcttaccaagtaggtaattttgaagcatgtgaggttcaaccaacaaagctggttaggaccactgatacattttttacccttagcactatatatagtacctccttcttggcaccattaaggtggtccagcagggaggaagcttacagcttgattttctctttgtatggtttactcagtggaaggtccttaccatcccattctggtgggcagccccacttttctggagacttccctgaagtccatggtatatctttgctacaggtgttcagttgtaccatctcaagctgctgacctctctaacccactcacttagtgtagctctagtcctgagggaggcttgctgctaggtgaccatgctgtcggtaactcaggtgtaccccccacctccttcgcagtgagcatttaccaatagacccacctaccaaggattcaccatgggaccgcatagtttatatgtattatttaagtatgatttgaaatgtctgaaatgttaagaataatgaaacttggttgttaactatcacatggagctgctggcataaggacagcttaagacacacacttccaaggagtttgtcatcttatgccaaaacctggctcttaggatcaatgagatggctcagtggatgaaggcatttgccactgtgtctgatgacctgagattgattcccaaggctcacactgtagaacgagagaaccaactttcccaaggtattttctgatcttcccttgagtactatggcgcatgtattccactccccaaccacagtaaataatacattaaaaatgcttggttcttggaaggacatagaatttacttcctcctagttcccctcagtcctgattacagcaaaaccatatggcaccaagtgtgggttctttaagtcggaatttagtttctattctgcttcagtacatgttgcagggcacatcaactctctaagtcccattcttcctagtggagtaccacagtgctgagcattacaggaggtcccggtgggaccctcagaatcccacatatagtgaatatacagcattgtttttgcccctctttttgtatgacattggtaagtgcagcatctaacctgcagatcgggccagtacctcagggggaagagggttgcataggagtctgtgtctcttttcctttggcatctctcattctggctgttcacctcatcccccactggggcccatggtgccctctcttgcactgccaactgctctctgtctctcttttgggttcagttggggctctgagcagcatggggtgtaaatagcacatgttaggcacttaggaagcatgtcccagttctgttgtgacatagaaggaaggaaagggatggagggcttggtttgctttgtgtggaagaagagagacttagagatgaatgtgtgggtggctttcctgagtgacagacataattattctcctgtggctcatggaggccatgcaatcatggttgcctggacaagacctgctcagagtaacaggctgtgcggagcatgtggacttgggagtcagacactctcgtccagagccttgctactcccagtacagttggaccagtaatagggttcccacccagaacttccggaacctagccagaatattcaccacaaacatagacatgtacatagaagactgaggccagtgcttctggagcctggactctttctccccggtcaaatgagacagggcagtctatgggccccggcttctgattctcaaggttctagttctttccctaggtcagcagcagcagctttgcctgggagcttgttagaaatgaaactctcaagccttacccagtgccatgaactggccctctggagtaggcacagctcacagtcaggagggagagttcttctgcccagctctgctgcacaacaggattacaacagggtcaatgaggtaaatggctggatgcaactcaagagtatcagggagtgtaaggaaaaccgggagtctgaagagcttccccacagtcccagtatgcatccaggaccttaggtgatatcctaagccagttttctaggctgtcagctgggttgacgtattcctatctgccttcctgtgacgtgctggtgccttggagagcatcatctttgagttcactgagacctgaaaaaaagcacggagggacaggtttccttcagcacccaaagagacagctgtgactcctgtttgagggagaccagattatatacccactgtggcctcaagcgaggcacacaatgatgtatcttggtgatccagggatcaagtattttcaagaccactgtgcttaatgtagccaataaccctgctcgaggaaggaaaataccagtgtctagggatctcagcttgtgcctgctttctccttttaccctactctttaccaccaatgggaagttctgaggctcaatttgagttggggcatttgccctgtgccatatcatgctccctttaattaggatgatggagctgttggagggaattggccccctcactctgagtactgggagtggtggcaaagaatgaggtttagaaaaatatttacccaaaagtaatccctctgctattgccactgcctgtttcccgggatgctgggcaacaaacacggagtctggtcatcatttattgagtttatttattaagaccagggcaagagggtaagacaaggtggtgtggtctccaactcaattcctatagcaggcagaggctggggtctcctgggaaaagctatgacatatgacaaccaggaggcatgctgcatgcttgacaccaaatccacctgaacaccagatacaggaagacttcataatcttattttaagtcaggcgtggagttatatgcctgtgactctagtacttagaaggcagaagcagggaactgtgaatctgaagctacataacaaagcccaggactgtctgggctgtatggaatgacttttactcaaaacgaaaacaaaactaaaatctttatgagaaacaggtctgctcttagaatctcaagtgtccagcagcattctaagaacagactcgtgtgattcccagccagtgctgtgggagccagggctcatgctctcccttgttctacatgagcagtgcaggcctgcggggttcgtctctacatcttaccagtgggaaagcagaagcccagagatcagatgcatgagcatcacagggatgagtgtcaggaaagaaatgagcagtcaggccctggtgtcaagcgcataggctgggaaacagggttggctgatatctccccattttgtttttggtctgggatggctctttggcagagggcttaggctatggaatatccaccaaaaactcaactcataggatatgtgtgctgaaatgatggggaggatgtcacttggcatagtaaatctgagagtttttagagtgtatcttatgtaggaaagcatgctgcacattgtgcacctctgtataaatgtgtacatttatatatgcatgcatgcacgtgaaaacatgtacagtggaagtatatactgtgctgcagcttatacacacacattgctctcatggaaacggctcatgaaacaatagctaatcctcacatgacatgatatgcagcttgacgtagcttcttaaagattactgagttataaggcatatacagcaagagccagatgaggagtacagcatgagtctaggacctgagcatgacaatttctcttctagtggagctgtgctgtggaagtactccatgccttcctagcctacctgacatcatcccatccccctccatcttattccatatcatcatcacaccattccatcctctcccatcttcttaaaaatttgcttgcaacccatttattagactctatgattgtgcatgaggccaaggcttgtcttttgcaaacttgcagtgtggtctgaatttctacagtttgtaaaagaggaaggcaacatttggttttacaagccatatctcttagtcaaaaatcttggatagattaccatccctacgcccaccccacccctatgcacagaggcacacacacagaggcacacatacacacacagagagagacacagagagagagagagacacacacagagacacacacaggcacacacacacagaggcacacacacagaggcacacacacaggcacacacacacagagacacacacagagacacacacagagagacacacacaggcacacacacacagaggcacacacacacacagacaacaccccccccacacacacacacctgcaattgttcagtgcccctggccatttctctgtggggttccttgcccacatgttctctccctcctgttatgaataccttgtatactgtggtccctggagctggctgtcctccctctgaatgccatctggcccaggcttctttctcctattggtcactattcatgttttccccttctaagagcctgaacatggcttttgattccaagatccccccagaagtgctgtgctgaaagacacaagtgtgaagtattttgagtgatgaggtgtttgttttgggggttcataccaccctgttctccactctgagatccccaaacactttgagtgtttattgtgcacttacttggtcatttattatctccatggatcagcgtagtctgctgtaccttcatggaagtgccactgttccaccgtggcacagctcaaatctccaagattcacttgattcctcaaatcagaaggaatgacaattctgaagcatgtatagtctgggaagttttggatggatgggggacttttgacttgagtgcattactgatgatggatatatgttctgtgaagtagcagcagacagcagaaagcacggggaccagtttctagaacgttgactctgagggcttttgcgagcacagtttgagtgacaggtatgaagctctttggaaagtcacgattgttacctacctatgtgggctgatgccctttaaatgttctcagctgtaaactctcatcacacagccaatgctgactttctcagaggcccactgtatgctataggggaaaagagctgctttgccacagctgaaaaataactaaagtccacagtggggagaagggtgtcttctgactgtacattagctaccgcccttggtttgtttttcctttcttcatatttccatccttcttaattgggtctgctgactacacacttttttgtctgcacattctgtaactaccattaatctgtgggccctcaaacataatcccgtgcttctgagtcttcctcttccagctttatattttggaagatccgaagtttctgagaacacgggggtcctgagactagagaaaggtgaatttgctccaagttagtcccaagagaaaggctctcatctaaatgtctggaagaaatcagactgagggtgttgtgggctttaagtcaggtgctagctctcccatagaaccagaccccagctctggctggtaggggaggggactgggctggaaatgagatcctttgggggcagaggttgtgtcccaggaaacaggtggtttatttaaaaaatgaggaggaattattatactaatttttaaaaattcatggaagtttgaaggaaaacaaatagaacatcaagatgtgaaaaacatattagcacattgaaattattcccttcagcaaatagtgtatctgtttgctgcttatctttatcataaacattaagataggatttcaatcttaatgaccaaatcttccagaagttttgtgtttctatccttaaatgtgaagtgtttttggtgagggaaaaaaaatctatcagggctcatgccaccttggcccaaattctgaaatccacccaaacattgtgagttcattcatgacttttatgcggtcagcttagtgcgatacatatattcatggacatttcactggttgatcatgtgcattttactctcccagagtcacctgatgaatgccctaaaataaaaagaattgaaattctaaagcatgctagacccatatagagataggtcaaagcctttttctctttctcccttctctctctctcccttccttccttccttccttccttccttccttccttccttccttccttccttcattccttcctccctccctccctccctccctccctctgtctctctctgtctctctctctctctctctctctctctctctctctctctctctcaagttaaatgtattatagggattgcaaagaaaacagagtttggtcccaagaagacctggtccacatctgtgtgtttcccctccaggctgggtaaccttaggttataatgtaattttgggttctcagttttttccttgcataactggactctatacattttttaggaagagtttgatcgaggtaattattcatctcccttcccctttacagccttgcttttagagtctgaatgaccccacctaactctttctcccctgggaagaacccaggaatttttgttgttgtcgttttgttttttgagacagagtttctctgtgtaacagctccaacagtcctggacctcactccataaaccaggcttggcctcatactcaagagatttatttccctgcctctgctgcccgagtgctgggattaaaggtgggcaccaccatactgggtcaaaccctataattctttatgtaactgaattcactcctcaggccaatgaaggggatattttcatgattgctagtagcagcccctcccccaccccccacccccccaccccaggagttcaagagtcactcacatttatcttgaagccagtggaagagtctggttacaggagggcaggctgtcagccagagagctggccttgggtggccagactttggccacttttcccattccggggaggtgatggatggtggagttgtgatttttaagagggacctgaatgtggttaacatggtgacagatacggatcttaactgggcacagcttgcaaattccaattaatctgatcccaacccttgggaaatctgttctgcattgagcttgaactctggtctagggctcagggcccaatctgttacagtgccctgcaagcactcagagtctgtcccctcagtcaggtgttctgcaggacaagttctgccagggctgtccccagtacagtaccctggtcagggagaggaggaagagtacacagtcccttcctgtgtgcccttccaccctcctcttcctttgccttctttgttttcctctctttccattctctctgtagtggagaagtgtaagactattcattttctcataccataacagagtccagtaagaaaccagggagtgagtctcctctgtccagccctgggctctgggcaagacatggcacatgataaaaaacttaaaagcaaccaaatgcattgtctcagacaattggaatacctgctgacactttcctgttgtgagactaagttgtgacaatggagttctatccagcaaaggaaaaagttatcctggacagtgccagcttccttttatcccagggacagggacctctaccttcagggaaccttatgtcaagcacagctttggaactcagcacggttaggcctgcagatgacgtcactggctttctgtgggacagctgcagtcagcatcaggacactccaggcatgccagtggtaactggaaaccctattttcaaatgcttccccagcatttgtgcacggtgagaagtgcttctcttagggcacaaagactgtccatagcgaggtcctagggagatcaggaccctctgaagactagggctaggctctgtggggggagggggaaggagcacatttccgagaggcgtactgttctgtcagtgggattccacttgaataggtctatggtgagcccaagggttacattcctaagttgtcattgccaaggcctctttttgcaatttcacttacaaatattgtttttgtatcagtctatgcccactgcctatcttctttgtgtatcagggcagcagaagtggcatacaggtagagaaatgcagggaggagggctttttccaagttttattctgtgtatatgaatgttttacctgcacacacatatatacagtgcttatgaaagccagaagaggcttttggatcctctagaactggagttaagggtagttgtgacccaacatgtgggtgctaacaactctggaaggtcctctggaagagcagccaatgttaacgctcttaaccactgagccatctctccagccccgtgcaaagggaagttttaatgatccatagccctacgcctgtttcagggtctgcaaagcaaaagagatgttagatatcagctcgctcgtgtgtcttcgaggtggaaagtacagtgaatccaggagagttaaaggggctgggaggctcacattgacactccatggggacagccacatgcaaggagctcctgggggccttaggaacagtgtcagcttcagttgaaggcccagcccccactctagccatgggccactaaccactataccctcagcagacactaggtatcctaccgtgtcgactcctttggttctcatctctactttcttgggtgggagctgtctctaacattggggaaagtgactcagaggatttcagtcacccaaggtcacccagctggttggcacaaggcctgttttggaaccaggatgatctactgtagccccgccaggagctatttctgtgtgtatgtgtgctactggcgatgaaacctagggccttgcacatactaggccagcccctgtaccgccgagttagctcttgctctggtcctaaggtctgcttggtgacagtgtccgaattacagttgaattccccagcctttcagctttcttttgctcactcgtgcaatagcatattgcttcatagaactgttgaaaacaggcacttggggtaatggttttaaggtggggacttcccccaaccccccacccccccccccccgtcccatcctttaaatggcaggccgattgtcagcattgtctgaaaatgcaactgcctagcctagactaagaactcaaaggtgatgacttgcagaagagtgcactcggcagggggtgaaaggacattcatggatcagtctagggacagtccctgaggtggcctttgatgactttgctgtggggcagtggtccctctcccagcctggcttatgtgcttccttctctaggtttccctgtctgctgctgccagagtccacctccccagagggctgacaattgggtgcttctgaacttcttcgctgcctcccatgttcagaagcccgagctcctctggcccaaagtccaggcctctgccctctgccctggggcttgcctttccagaccccccttttccatgctgctgtaaatgcacgttgatgcccacagcatgctctacaggtgcttgctttctaaactcacatgtgtttcctggggttcctctccccctctaagctatctgggttccttgtcttctccagactcaatttattattttttcctttcagtttacttaccactcatctgttatgaggcagtgtgattcatggggggatgctgggaaaaccaggatgcacaaagacagacagtctcttgcctctgaggaggtctggatccaggaaaaggactgcctaaagtactgtggtcagtgtcctgagagtcaaggctatgtgtaaggtcttccacttacaggaagcctttctaattgtgtattgttatggaaatgcccttgcttcaagccttatgcatcttattccctgttttcttttagttccttgtgttttgcctgatataagtcacattcgttatccacagtattttttggattttagctgtaaggagcaaactacaccccctagctctgtcctgtgtgcggaataatccaaacgagtttttattgaactctgattacaaagctagctccttcagatccctgattcctcttgtttgttatcatggtttatatttatgtgtgtatgtggggagaggaggtgaagaggggatttgtacattggagtgtaactgactgtcaagtttagaagaagccattggaccctctggagctggaattgcagtggacatgagctgcccagtctgggtcctgggaactggactgtggtctctgcaagagcaatacagactcttagctactaagacacctctccagacccattttcatcctaactctgtgggtatgcgagacatgtacagtgagcctggtttgtaaagagtcagagacatattcacaggcacacagtacttaagtggcatggtctggctgtgagttttccaaacagctcaggggaaggataggtgactgtggaaaccttccctggaccctaacacatctttgaagggataaatggtaagtcgagagggtgaggtctcatggctgcaatgcaggtagttcattgaggatcgtgtcaaatgggcaactgggtctgtttgggtcaagggtgattcacacccatgcacgggcagagagagagagtctgagacaaataacagtgagaggactcatcaggcctccctgtggtgccattttggaggggtttggggaggatggaattcaatcaaaggcaaggattccttgtcatccatgcgggaggaaaagctccaggcccaagcattctgctaacaatgtcagagccctcagctggtctttcaagtatttagtggacctggggacaatgtgcacagccagaggaatcccagctccctctcagcctggctgctcatgctagggtctgcaatgaaagcaaaggcacagccaccctgtgcacactagctggctaggaggctggggcttttgaagctcagctgtttgagctacctacgtgtttaaaaagccttacctccatttaagaagaacaaagtctgtttcttcagcctgggcacaaatcaaaaatagttaatttttttttttttttttggcttcagtttaaaaataaaaaaagtcacctttgggttgagatcgagaatggaaagtttcagggcataagggtaattttgttttttcttcttttttctgggtctgttctaggcaagggcagttgaggtgctttcatgaaagttatgtgtaagtatgtaccatgtgcctcacctctttatggccccgtggtgtcccctctgttaagttgatgttagtaagattcctccatctgtctagcacagcagagtgttcggagtagaggggacacgtgtgaaattggatataagcaactaattggaacgcaaaggagatgattaaaattaagctgtatcttctaccaaggtggctttatcacatagagtgcgttttagcaccccaaatgagcaatgactcaggctcccaattagttgatgacaaacctctagagaggatgaagggcctaggggactatattgacaagtgggattaaaaatggagactccttaggagttctactaaaaaaaaaaaaagttacgaaccccggctggagtaatagatcggtgtaatgtctgcgcgcaagcttgaggacccaagttcaatccccagagtctatattaaaaatttgaaaagctggatatgatcagtggtgtttgcaatctcaacagtagggcctgggggaatggagacagacatgtctctggggctcagtggacagcagtagcttcttccgcccctcctgggaaaactgcaggatcagtggagcagggcaagggcagtggagcaaggacaggcacaatgcctgagctttcccactggccttcacgtgcatgtgtgtatacatagacatcccctctcacgcatgtacatgcaccctcctccgcaagtatggacaggccctgacagctagagtgagctttgcggagtgggatgacttgtttgtttgtggtcctctggcttcacagcccactgttgccaaggtgtgaagagacagttgttttgtgtcagttttactgtttctgacaactgttcctgaggaaatatacatttgtgcaacagaccgcctccaatgtcaggtctaaatttagaagccacctccgacaggtgctaaaatcagtcatacagaattcagggcggtgctcaggaatactgaatacccatgaggctatcatggcccctgatagaacttttgtgtcttaggccctcaagtttgacagagtgtggcatattttctgtggaccaggctccagacaagtacagtgatatgtcttcttggaactaaatccacacagctggaggaagccatgcctggtatgatgccattgctcccatctgggtacctgcactttcaccttgactctgtaatgtaccatctgtgtgtctggagcatccttacccagagaatgagggcacagaatctttttaaaaaataatttactggggatggagagatggcttagtggttaagagcaccgactgctattccaaaggtcctgagttcaaatcccagcaaccacatggtggctcacaaccatcctaacaagatctgacaccctcttctggagtgtctgaagacatctacagtgtacttacatataataaataaataaatctttaaaaaaataatttatttttgtttcatgtgcattggtgttttgcccgcttgtgtatctgtgtgaaggtgttggattccctggaatagaggtacagacagttttgcgctgccacatgggtgccgggaattgaactcgggtcttctggaagagcagccagtgctcttgactgatgagccatctgtcctgttgaatcttactcactctggggtcatttcctgaacctgagcaacatgattaatatacaacattcaggttgggaagaagaacttcaaattattgttccttgggtttgtagtggtctcaactaataacacaagaaaaaagtcttggttctgtcaagcggacattgccctgggttttgcctagtttctgccctggatgcccctggacctacctatgagacaggacagcagggagcctgggcccatggatctacctcacatttttaattttactgactactttagaggcaggatctgactacttttgagacagggtcttgctatacatccccagcaggccttgaatttacagcagtgtcagcttcttgagtgaaggtccattttctttggacaggatctcatgtatctaggttggctcagcacttactttgtagatgagaatggcggtctttcaactccttttccccctaaggtgtgcaccattacacatttaatcgtttaatcgtgtggaccatcctgatgtatccgtatagcctcctagtggatggagtctgtacaagtgaattggcttttccgtgtctgtttttgcacctgaagcttatcataagcagagtatggggatgaggggatagtctaagtctgggtccaggctttggtctttttgtcacttagcagtgtgaccttgggcaaaccatgaagccttggtcaacttgattccttccttgtatgtgggggtacataacagcactttatttgaattggtggtgagatcccataatctatgtaaagtatttacagtatagaaagcactgtcactgtgatagttctctgtgctgtggaaaagaatgagcctctctgggctttgttacagatggcctgtgtatgtttcatatgttacattgtaacatacagttctcctttgcttcaaatcctctatgcatctcttatatagcaagcaaggtaagcgttgcataagtagttgtgatattgtattatttggggaataaggacctgaaaaagaaggctgaatgtattcagcacaggcacaattttgtttcaactattcccaatcctcagttggctgagtctgccagtggagaattatagatacggaagttggcttgtatacatcaagtgagataacttcattctgcatccggcaagataatgcatgtaaaacccctcgaataattcttgacaatcagttctcagtgaacagtagcagctcttatctaagtagcttctattgggaaaacacagtcatatttttgtatcatttcatttcagtctgtgtctcatccaggatctatactagctctgactagaacaaaacaacacacccccaccaccacagcagcagccaaacaaccgggcttgaccacgttgtctggaaatttttgcctgttcagattctcatcatacaagtgttcccttctttttctagagggcacttggggatgtgaagcctgggtacagagaagaggactttggggaagaactccagctatgttggtggggaaagctcccttgggcctatggcctcaatgctttgtataggactgttcaggtttggcagaggagcttcttggaggagccgaggtctagctgtgggaatttaaggccttggactgggtaccattcctttgggcatcctggcctgggctgatgagccaattgcttaagtcttctctgctggggacagtctcagtggctctagagaccacttgagcacaactcttgggtgctgaagagccagctacttagcatccaggaaatctgatgcctgtattcagagccagggccacttagaaaagaaggctgccagctgcctagatcgaaaaccaccttatagggttccatatactctttccctgttgttttaggttgccccaagagaccactgttggccacaaactcttgtgactaattaggagaaatccatgaacctcccaagtgttgccagacagcagattgggctgggctgactcagggctgattgtgttctagggctgaagtccctaagaaaaataagccatcaggccttaacaagcatatggccagttactccctcacaatctgctgtattttggatcttaagtgtcccccaagccttgtgtgttgcaggcccttgaagaattactatagaaaggtaattatggggttctaaccctttcatcaaattcttcctctttcacatcccagtgggatgtattggtttgactcttgccgtgtgtgacctgctggcttgtcacaggcccagagcaacgggattatttgtctgtgggctggaacctgagcctaggagatggagtgtacctttcctgtctataaggtggttatcagatatttattacagtcaaagaaagctagtcaaggcacattaaatgatttttgacttaatttaaataaggcaagaatgacgaacacttcagcagtcaaccagactaggcctttctgagcctttcctttaacttcccaaggacaccaagaataccaactgcattgatttcactgtgaagctcaatgggatagagagcttgcaaaagccttgcaaattatttctctcaaggtaaaagaaaatattttcttgtgattcattgaattggtgttatgtagtaacatgaattagcatttacacacccaaatgcctcttgcctgatatagccttttgggagcccaattttggacgttaccctacttacttaggggaccgtataacagagcgaggtttcctaggcagtctgaagttaactgtcccagataacctaaaccattttgactgcatggggctgggaaatccagagccatccagcccacccttcttctgggtctgtcccggctgggtgtgtgtacttttacgtctttcatgagccagccactctttgggtatgagaagcttgcatcgctcaggttagagaatgcccctagctcatgagccctacatcacagggataattgtgggccttgattcatagtgagtctgaaggctctagagcaatattaaactgcccattggtagtgactgacagctttcaggattgaagtaatgagttcagagcccccacttgcctgtaaagcaccgtgggggtaatttccttgagtagctctttctacctaccttccagaaacctgcctcttgtgctctctgtactcagtgggtgtcacattcatctcccgctctttgaccagaattaattaccggcattatccgagggagttatttatattagtctcaaaccaatgagctactgcagctggaggaccatcaaatacaatgtatgctgattgcctcagtgacttccaatctgctttggcaggggctataggagaccactgagaggcaccaggctattattactattatgtttatgtttgtttatgtttaggattgatgtctggaggctggggctagggctggggaagtgcccaggaattctatttcttagggagtttggcttttatgtgtggacattgcgatgtggctgttgcacatagatggatggtggttgcctgtagttggatgtgaggtccctgattgggagtcttcatgacctggatgcccatgttcatctttgtccccagacctcagtggttcatagttccttccacggtccaagtttctacctgatgcagtgtagtcactgtattgagtcaaaggtgtcctggatgctcagcgttgtgtctctgtcttcaccatcagcccactatggagagcacgctagaggtgttagcactctgtcacataagttagaacttttaatgccccataaccacttccagaactatccttgcattctcaagtgtgtgtgcatgtgtgtgtgtgtgtgtgtctgtgtatgtgtctgtaggccagagattgacactgggcatcttcctctatcattctccaccttattattttttaatctgactatttatatataaatatttatttttgatatctattttgtgggtgaggaagaggggcacaccctgacaaaaccctgactgacggcgcaggagttggttctttccttctactatgtggctttggggaagttggacccacattgtcagcctcggtggcaggcaccttttcccacctgaaccagcttgctcggtccctccaccttgtgcatcaaaggtccttacagctgggctatttcctactgatgatctcctttgggcagagtgggtgggaaggctcaggagaccctcacctgagtatacagctggatgcagttctgctctatttgcatgtggctttgggatctctgagagaggctagaagacatgggggtggggtaaggactggagaagagccctccatttacatagccttggagaaaccatcagttcttccactgaggctgttttaaagttagccatgctcctgcttgaaacctctcccacactgtgctgtaaggagatgcaataaacccatcggttccccagaatgtactctgatggaatcttaccttcctttatcgtggggactcagggaggaaggggacgtttacatctccacaacagaagggattttagccacaggcacttgacccaagtgatgtctgagaactgtgtggaggaggggctctgtagatttccacacaagcttctctgaggggatcttaggaggcctatgggagcctgaagtttggtatgggcccctcagagcttcaatgttggttaattttcatgtatcgattcaagattgtaataatgtagtgagttttaccttgctgatacaagaaaaccctcaaggctccagaatacaaccaggattcctggctttgctcaagccactacttcattggcaaatgccacttgggcacagggggtctaacttgagcctctgtacagtcttcctttcacctgtttaatctccaaagtgttacaccatgacgtttttacactgttttgatatatcccttctaacttcagcaaaggattctgtactcctttgtgttgagtcacctggaaagaaggaccctaacttgaggaatcacctccatcagattggtttgaaggcttgtctgtgtgttgtttttcttgattaatgattgatgggggaagggcccagtccattgtcagtggtacctctgggaaaaatggtcctgagcaaaccatggagagcaagccaggaagcagtgttcatccatggcctctgcttcagttccggcctccaggttcctgcgtgagtccctaccctgatgatgtcttccctcagtgatggagtaggaagtgaaaagttaagtcatattttacttatcatagaaatggaaaacacagtaggaccgactctgattgaagctattgggagctttgttgttgtttttgttaatcaaataagcaaaacagaggtacaacttttttgaaaaatccaattcagaaggaagcttggggaaaaaatacataatagtggtttgccactttagtaaatatttttcttccttctggaaggaagcttggttctttcttgaacctgattttaaggtcacttctctaatacctgtgctgctggcccctctcatccccactttgtaggttctttttctttaataccccctttgtagaatagccagaagtgatctttgatctcttgagttttatttgggctcaaattaagtcccaagacaccctacagggatttgtgactttgtcatgtggttatcatggcttgggagggcaggtcctgctaactccttccagaagcagatcagctgtgtgccactatttctctggctcccccaacccctgacaccaggcccctcactgctccaggaaaaccaccctcctgcagtcttgattggataggaggagtctctgtttaatacattttcttatagcagctacctgtatgcgtgcgtgcgtgtggagggaagccacagtttgcaaaccagagggggactaggcagttctccctagggaatgcttttcctttgaacagagcttgtgatcacatgatcttggaagctggaggcatcagtgacatttcagtacagccccttagttcctctaccctccttgtttaatgttttctactttctctaggacgtttaggccccgctttgtccacagagttgtgatctcatggtttctctgtgtgtagagtctctgaacaaaatgaccttctaagcacccacagccttgggaaggtagtctctccagccagagaccgggggtccttgaactttttcctttccaaactgctcacaggatttctgtgtcatcttgtttaccttactggagatgagctatttcattcttgtctggaacccttttcggggaatcatagttgtttctgcgctgtaccccatggtatcaccaggctttcagagggtgaaaaatagcagacttgtcatggttatggaaaatctggcctggcttggccccaaggaatttgttaggtctgctttgaagagcaaccctgtgggctcctcccttcagcgtccactcgcagtgaccttggttggtggttccctgtctcctactggaacaacaacagagacattgatccctacttgaaccctttcatttggaatgttcagagtgaaatacgagatccgtattatttaaactagatctaccacagcttctgtgcctgggctctaccactctaggcaacgcaggaagggagggtgactcttgtgggaagggcctcttgtgcttttggtcactttgagtttggctcctggcagtacagctgttttctgggaatgtcttgctgctgatgttgatctgttgggttggggacactgggactcagttcctgatggggtatgacttagaaacagccctgagacagtctgctttctggaggtgggatgtcctagagacatgactggtgggcccttgactgaatagttcaggggctttctctgggtcaaagtgttgtctggccctggaacgtgttctctgtgtcccaacaactggattctcagacttggtaacctggggacagtctaacaggatactgttacgcactttgggcctggcattgggaagcacttcacccaggagtgccactgttgccatattccagccctgccctctgctctcctagatgctactcttcttagtgtggcaggagaggatgcttacctgggctgaagggccattagctcatgaagccaacatgggatcatttaaaatatgaatgcaacaccttttcaaaaatgcatattaaaaataggttttacaaagggtcaaaagataaaaaaagtttataatttagcttaatgaaagatgtatcgaagattactgtgacttatttatctctgctatgccagtgtctgtactatttgtgatgaagcaatattatcactgcttcctgtcttcccttactgggagtgacatcatgggctgccccaggaacccagggcacagtggttccccagtcatctgtgacaagagaaaaccatgatgaaaaccaccgcaaggcagggaggacaaaactctgtgttcttagaagggtacatgattgaaattcacagaacaaagtgagggtgatgagcaggatgtgtgtctgcaagctactcaccacagctgctgcccagatgagaccaggtgtgggctccatattaccctctttagtgcccccacactatgtgaggcatattgtttctgtttccaggagaggaaacagacccagaaaaggacacagaaatcacagagctgaaaatggaggaattatggtcctaactcaggagtgaccacgtccccagacctcatggtttttacccacagcagtgtgctgccttttccagaagcagaagccaaacttggtccaggctcctgctgcccacctcatccctcctccatcaggatttctggccccttggcactggcacattctccagtgatggagtttctttctcctctcctgccagctaggctcccggccttctgtacacagctcctttctgggatgttccatttgcctgggggaggggatggtttcccacagtgactcccagcctctgctgctgctgacatttttctttttgctcctctcagttgagctaggccgtgcaagtacgaatccgcagatggctgtccgtgagagatggaccagatgagaaccatgatgtctcctttgtaggaatggacttccaagagctgcccccagaggagctgagctgaacagcacaactgtgactgttcttggggctctatacagaccaccctggggaagaggtgatctatcactcataggctaaaactgccaggcacactctctctcaaacttccaaacattactgtgttcaagcagaaagacttaatcaagggaacatcttggccacacattggcctctggacagggataggaaggtcaagggatagagatatcaactgaaagagcatccccgaaggttcaaggtctgtgggttcggcttgcttatgtactatatttttattgaggggggttcctcagtttttccacttgtaaaatggtccataagagacttggagatttctagaacttcctgctggtgaacttctttgtgtttttccaccatggctgggagaactctgggtttcagttgcggatactggataaatttgaatttgggtacacaaaattctgtaagaggaattgggcataaaggtgaagtgtccttcctcccatccatcatttcaagttcagagcataatctggtcttgtatgctgttagcagcattgacttaataacatgtatatggggacaccacacacacacacacacacacacacacacacacttacttaaataaaactaccattttcctgtatctttgcatcacttttatattccaatatgcttcagtttctcccactctgagtagcttcccacattcttagaggcaaaacttaggggcagagcctgtggcattgcttagcttgtgggggcaacatataaaaatagcactccacacggagttctagtcctgcacgtctggagttttatttccatctttccttccaagactcaacagctatgccagtgccttagcttaaaaatgctccccctcctctgagaatgtgctccgagggaatccacagagctgtgcttctgcctagaaccagccagcttccccctccccacattcccaggaaggggggcatgcctgcatctggaaagcttgtttggaaattttcttgaaggtacctttcggctcttgagtttggtgggtctacaagaagtcccaaagctaaaacaagcagattaacagccgcacagatgttagatcgggatgctaaatctagagataaaggcaaagagaggagacggagagcatagagcttctgaagaagcacaggatcccagaaagttctcctgccttccagaagctgaaggaagatggctctggctccgtggtcctgcttggtagcagccagggatgtctacactgtagaggctgggagaggggcggcagccccaaccagaactcatgtcagaagaagccttttggtggactgatgtactccatcttcttcttcaccatcctaatctgatacttatttcccctctttctccttcttctgttgctctatcctggcctggagtaacactgaagacatgagcctcctcaccagacttaggagagtggctgggataggagatgtcgccatagagccccaggaatgcacacagctctgcatgccttccttgtcttctcatcttccccttctgaaagagaagcagtgggctatgggaatataccagttcctgcatgccccagcattgacagtgtgaacatgttctctgatgtgattgaatagtcccaaagatttcacttttgccctcctctggaaaatttctgttattactactaccataggaatgctggtttgaaggtactgtcacctgtcacaagccatggtagcctaaaatggggtggaggactttccaacctgatgcctaatgttgtgttaacagcctggctgggacatttcagtaaggcatcattgaaatcctggggaataacaaaagtgaatcaaactgaggatagtttcctcagcttctgtcactgtaccaaaatccctcacacagggtatttatgaagtatagaggtgtttatttgggctcatgattctggaaactcaaggtcaagtagcccaatggaattgtgctgcacatggcagtgggagtgtatgtctaagctggcattcacagcatgagtcaataagaggagaggcatcaaggaggacacacaaatcttctcctagagcctcaatatctgacagactttctactaggccatagctctcaaacatcatattacccctcaattcctctaccctgggaattaagcttgaggggcaaccattcaaaccatcacagtggataccagccagatctctgtcatctagccactctgtctctcataggtcacagcctctctcagcatcgttattttattcaagtccaacaggcccggtcaggttctctctgggtcccatgatcacttatcttctaggttcccagccagcaggactttgagcaaagaagaaggtgtgaggctaccaatgttaaggagtatgaggtctgtctagcatgattgacaagaggagtgttgcttttcccattcagggagacctgctccatggcattcctcatcatgataaattgagttcggcactgccaacaactaccgagataaccaaaggatgggcaaccactggcattgtattgaaggcaggggaccgtagtgtttagatatatgtgcctgagtgttacttgcacccctctccccttctagctgtgtaatcctggaaacctggcttcactgctgtggcctagtgtcctcctttgctgagcatgatacagagagacctttctcagtgctggtggctgtgacattcaggttcagacatctatcgagtttagaactgtcttcagtctattttgctccttgaggctatcaacatgccatttttgaagctactctgtctcaagtgcctaaaaaatgatctggttcataggagatgcttagtgattatgccttgatgaattgagagctggggataaagtatagcatgtggtatgaagccatctggataaatagaaaaactagagcccagaatcataagagcctaaagctggggttctctccgtttagcttatggaggctgatatgcccactgtccctccaggtgtcatagttaatttcagttgtcaacaagatgtacagggcaagtgagaaccttaactgagtagttgccttcattagaattaaccatggacatgcctgcaagccatctttctttctttctttctttctttctttctttctttctttctttctttctttctttctttctttctttctttcttccttccttccttccttccttcctttctttttttttttttttttggttttttttttttttttgagacagagtttctctgtatagccctggctgtcctggaactcactttgtagaccaggctagccttgaactcagaaatctgcctgcctagtagaaatcctcccaagtgctgggattaaaggcatgcaccaccacacccgggtcatttttcttaattgctaattgatacaagagggcctaacctactgtgtgccatccatggacaggtgtggtcctggcttgcataggattgtagctgagcaagcctagagtgcaagctagtgagcagtgttccttcatggtctctgcttcagttcctatgtccatgttcctgtcttgagttcttgccttagttcctgtggtggtctgagaatggtcccatagcctcatatatttgaatgtttggtgtctagttggcagaagtgtttgggaaggattagggggtgtggccttgttggaattggtgggtcctggggataggcttgatgttccaaaatcctagaccagtcccaactacctctccttctctgcctctcacttgaggataaggaaatatctcttagctacggctccagtgctccatctatttgcttgctgctctgcttcctgccatcatgatcatgaacaccaaccctctggattcacatgtgatccttgccaaatgctttctttgccatcttaccatgatcatggtacctccacacagcaatagaaaagtaactaagacaggtccatgtgagctaatgtggaagtcagataaaccctccccctccaagttactcttggccagtgtttatcacatcatcagagaagcatactaggacaggcctcccagtgtgcctgtcaggaccagagttgctagacttggtagatggttgttcactgaatgaagctctgctaggggacagctttggggaagcctttctctgctcctgagctaagtgggcatgggacatgtgaccagctgccctcctgaagttggcactgcctgccttaggcttccagatgctgaatggagatgggcgtggtgaagctgtgttttagaataggcacatgcaacacttgcttctctgaggtagaacaatgatccttgtgaagctatgtctgcctcctgaagccctgggtaccaggtacctggtcccccttttacttccctgtatggttgaacaagtctcacgaatcattgttcctcatccttgtcctgcaatgccaatatatcctaaagatagtatttaccttaaaaggtctgaaagggtttggcaagatggctcagcaaatacacacttgccgtgacaatgtgaggaccagagataggatccccagcaccacatagatgctctctggacacggctgcctgctgttaattccatggtttggaaggcagatagatgattccctggagcaagctggctgactagaatacgtgttctgctgaggcctgggttcaaataagagaccatgactcaatgaataatccagagaatgatctaggtagatctctgataacagctttggtcaccacacatctctccccaaacccacatacatatgcaaaaagtctaaccaaccaaccaaccaaaataaacaaaaaaacccaaaacccttaaaaagcccctcactgaatagtcctaaatacttctgaaagttttataacctaagaatcagctatttatttatttatttatttatttatttatttatttatttatataaaaagccagatcatttgcagctgtggtgggccatacagttgatctaataaaacttcttttctgtccatagattgcagacagatttggttctcaggttgtttctctactgacaaccattttcgatggtggtttcggggtcagcctattttgatttgctgttcttgggtacaacttgagtcagataatctgaggaaaaagcacaatcatgtgttgactttgcccttggcttcttctctacaactctttccaataaatacactaaggagaaggtattgaaggttctagaaatatgtgtcttctttgaagacttgctatgtctggaaaggctggatttcaccccagtttccagttcatctagaaaggcacatagatgggccaggattggaagattctgtgttgggtgaggtttggtcactataaattttcaaatgcttggattcttggccaagatgaatgaaagggaagggttgtttgagccaaggcatactatttaaggcttagtagggtgtgtgaaatatagtcaaccagttccatccagtcagccaagaccacaccattccttaatagtttatagtaagatgtgcaggtctctggggaagcaatggtacccattagcagtttgggtggatggctggatgtcggaggcactcgcttccaagagagaaatctagctcatctttgcacaggaagtttgatggaaaggtgggcactcttactcgacactcttgctattagcatctttcattttgatggaggagtgttggtcctttgccctggtggattgtccaggatgggatggtttcttggatcaagttatgggcatgttttagaacaggcatttggtgtggtggtgagatcgtggcttctagaaccagattgattcttggctgtgcgttgttacttgtggcaaccctccagtcctcgggctctgatccttgtctgcatgcagagggaagagggggtgtatgaggtgtgccctcactgctcttggacattgggtaactcttagtcacaaagcagagtgacatgtagaaggtctttgggcacttacctgacaaggaactacacagttctaatgttcccaagtaggaataagtgtgaaacactcatcgggctactattgtatggtgagttgtctctggtgagtcagatgcctcttgtactcctctcagagacatgggtatgggtgtgtgaaccaggcagcactgaggaaggggaccatacctcaggataatgcatgaccttgtattagttagatagtaagaggggacaacagttgccttgggccatggacatcagaagctgtcttgctctgtccttgtcttagtaggatcctcaaggctgaacttgcccttgatcgcccctccccgtatgatagtccttctgtctaagcatgacctaagtcttgcttcctatgtctgtattgaggttgtccctatggttcctctttccttttggatttcttggggttctcaatgatgctggaggggctggagatattttttattgtgagttagtgaatgggaacaccatggaagagggaggccttgaaggcttggaggaggacaacagggaggaggaggaaggagaggaggagggggagaaggagaaagctgctgtttgagatagctctctcacttacgtagacagtgtgtgatcacaggcagccccacacagactttccttcaaaaaggaggagagtgagaaaatgcaatttcagtctgtggtttctgcctgattcctgtgaaggttccttctgggctgtggctagaagtgtctccctcttttgccaaggacactaaacctgggaaaagtgaggaaactgggagccttgcatatgcacgggggggggggggttggactttaggacacaaaggagatgacatcaaggacacagaaggagggatttagggacaggggagccaggtcagtggcctgactaagtctggatgagctatattgggtctctgttccgaggccgaggcttgctctcccaggcatgaggccatgttttccaggcctaggtccataactccattgccagcagaggtgtgcgttttgatggagagctctgtgcagagccaacagagtgtaatatttatctagaactgggcttcccagaagacgaccctgctggaaatcttgcagtcctgggagaatgttcttggtcagaccgggattccatgcccagatgcctttgatgttggcataggaaacaccagacagtgtgtgtagccagctggcaaggctgatgcatctctatgtgaagatagagtctggggagatgataattctgagaaagcccccctctcccacaaccctgcagggtctcatccctccctgcccagccagagagcaagcgctaagcaattccttcttggaggattcacagttggtggaaaatgtgcttagcattttatcctactttctccccttcactgtcagtcaggggtgttatgggagtaagaactcatttaaatatgagtagctgaaaaaaatatcattaggaagataaattgaaaaatgcctataatacacttctgtgctagatataaatgactcctcacacactgccgcacctacccattaacccggagagttggaagatgtttgtggtttgaagctttcctaggaacagtttctagggaacccaactactggggattcctcaaagcagaatgtaaagggctgcatataggtaaatgcgtgctggaaacttcatgattttgatgaactattacttgatgaccacttcactcaccaggaaagaaatgcaacctctttccagtaccttttgcatctgtcatggcatctgttggggagggaaaaagatgggcaggtgagagccttatgatttatgaccttgggtaatggaaggtccctcccatatgggaggggtttcgacatgtgtcctcagagtgccaagcatgtgacattagttggaagttacagaaaacatgggttggaccggggctggggtgacgacagtatggcaggagaagtgcttgctgtacaagcatggggacctgagctccgattctcatcacccacataaagatctgtccatggcagcgtgcgactgtgaagctgatgtagggaagagactagtggatctaggggcttctcttagtgtagtctaaacaagccccagttggtaagagactgtatctcaaaagatgaggtgcagaaattatcaaagatgacatctcaatgctagttgttggtttccacaaaacgtccaatacggttgatgcgagtccatctacccacatgtgatacaaagcaaacgagatttgtgttctatacaatgcattaatttctagccaagcatgtttgttaaaaacctgggctttgagtttgagcagaacaggaactgaaggtctgcctccaaccggctgaggaccttgggcaggaaattcacttttctggaccacggttccttcctcagaaaatgaatgaaactctcacaaatcttcataactccatagcattgctctgaggatgcaaggacaatatcagcagatacccatagctggtagttaaaggccatttgggaaatggtggggatcttcaccaggagatagtggccacagcagcagcagcagcaggggattctgcagtgctgtgaataggaagttgctcaggagtgggctgcagccctgagaattgccaacaaaccataccactgtagtttgggtaatagcttggtgagtggcttctcaggactgttgtttggggattcactggtactcttgctaagttgtgtccacttccatttagagatgatgaacaaattggtttcaaaatatttactgtaagcaagtcaaaaaacagtaacattcaggaaagagtattaaaaaaattgtttaatgtcttaatacctaagaagtaagcaatatagacactgagagatagccattcaatacttcggcccccagcccacccccatttggaaagttggaagatatacctagatacttacattacagttttatggaaataattttacaagaaccagaccaccttctgcattttgatcttgacattgaatattaatatacttcttagttttctgagagaaaatgaacacacttgaaggaagttctgatctgggtaagtgtttcttagttaaaataggtattttcaaaacatgtcactgtggttataaaaaaatattaggaagttgaaggtaatagctttcttttttaaagttagttttaagatctattttataggttaggtttttggcattttcatacattctttgttcttttaaaaacaaaaaaaattattttggggggcattttgtacatgcacacactatattttggtcataatcaccctccccacttccccactaacactttttggatccactcttccctcgccagcctttttaaaaaaagttcagttgagtccaatttgagctgcccgtatattcttgggtgtgggctcttccattggaacatggtcagcctacggatgaccacacccatgaaaaacctggctctcccttcccttgaagccaccagctgtcggtagctcctttgttggtgctgtggtcttacaagtcttgtttctcctcctggaatgatggctggctaggatagaggtcttaggtagatagtcagcttttgccttatctaggagacaatgtttcccctgggtcctctgtcccctttgcctcttacctatttaccccactttccctgagcctttggggaaggatgagtgagtaccccgttttcctgttccttctgaccagatgtgggtttcttggagctgatgaggacctagccggagagatgtatgagtaaatgcatcttctgtagaactttgacactatctctgtcgttctttactctaaccagtcttcctccacaactctgctcctcacgtccccacccctttcctccagtctctcccctcccctccagtcatctcctttctaatttgatgtcagaagtcacagatttctgttaataacctatttagatgtaaactttggagatcatgctgtgcaagatgaagcaattaacactcccagacttccccgtatctcctccccatttttccttatccagaaatggcttgagttttacattgttaagatggataatactggtaaatcccagacccctgttcctagtgcaggagttcagtgtctagatgcagtcttcctgtctaatttatttagcagtctgaaatgttgttaagttggtctttggtttgcttcattgacttgcaggctagcttgtttcatgacattgatattcttattaatttcatctaaagcactaagcactgagaggggatttattatttctttagcctgtttcctttaggaaagaactcatcagctcccacatacagtataccaatatggtccaagtgctatgagtgcttttatcttttttttttctgggagctttatctagtcataattgctttgatactataaacaactatgttgtgttcctgttctaaaactttggccttggtgcctgagctgatttctgatgctgtcaggggtttaggagaacctgtggggtgaggtaagacccagagatgtgttcccttgcatggacctgttgtcctgttccactgttcactaaaggggacacaccatgggccctagacattttgaccatcttctcaaagaagcattgaaccttggagctgaggagtctctatggcccaggggcccctgattgctgtttgcagttatatacccacttgttttcgacttgtctctctaatttttcccttttgaggtccaaaatgagaatgtggcatgcgtgcgtgcgtgcgtgcgtgcgtgcgtgcgtgccgtgtgtgtgtgtgtgtgtgtgtgtgtgtgtgtgtttgtataatatacccacagtttgcctctctccaaagtgtagccatcagtagaacgtgtttggacatggtcatggctattaatgctcctggttaatgaagtgcatgtgtgggtgcctgactggcatgcccacccctacctagtctttgcttcagatctcagggctgtaaggatgtggcagtcccttcttaactgccatggccttccttcttggtatttgttttttaaattttgctcaattatgtattgaaaaggtgtattttatcatccactatgtcatctttctctttccttatatcttcctgagtacctttatttattgaaaaacttttttttttttttaaattggattggtgccccagggatgaggcacagaaacttttaattttaccaagtgtcctgggcaattctaataatcagaaaagtttgatattttagtgttagtttcccctcatattcttctcaaccctaaggttctgtgcttcactgtattgtctttaagaagcaagcatggacggggtgtggtggtgcagtcctttaatcccagccctggggaggcaaaggcaggtggagctctgagttcaaggctagcctggtctacagaactacttagaaaaaaatgattgttagcatagggttatttctcagtacgctggagggtgggaggctcacaatggaggtatcccagtgtctgatgagaggtcgtgtcctgctccatggatggaaccttgttgtgttcccacagtggagtgggcaagtcagcacgctttggttcctaagaggagtctgatccagattccaatggttgggtcttcaacatacaactttgctgggtacataaacagtcagaccaaagcaaaggcataccattgaaggatcatgtagtttctgcccttcatgatccgaaagcactgcctccatcttagagcagacttgccctggagtttggtgtagatcatttgctttcatgggagagcacttggaggtagtttggatgcttcttcaaacaccgatgttgttctgttagctacttttcttgccactgccaccagtggaggaaagccatatggtggcttatggtagactcatggcagtgggacgagttaggtcatgcaaacacatgggcaacaggagaatgtgattggaaggataatatatcctctgaggacctgccttggtgacttttctaagcgaggtctcacctccttatgctttcacagcctccatacacagtgccaaccagttgaggatcaagtgttcaaacttgagtctgtggaggcatttcagattcgaaccataacagatggcttttccctggtcagaggttactgcgtcagagtttactgggtcagggtcccctgcccctgatgttctagccaatagatcctcttccttatttcctcagttatttagtacctattcttggctttccttactcatacaacaagccttcactaggggaccatgtatttcccacccactggatagttctgaaggacaagtggctacaacatgtagactgttgcattggaagagtgatcttgggagtaatggaaacccgaatgtggatcattttcctgcccctgctgactgtgtgatcttgaccaagtaacctaacttctctgttccccaggcaaagtgtaggaatttcaattctgtcttgcattgttttgataaccaaaattaatttggagtgctattaattatgagagacatcaattttctttggctttgcttaatatagtatttttttccctcttcattttcaactgtattaatcagggttctctacagtaacagcttctagagtgaatctctctctctctctctctctctctctctctcacacacacacacacacacatacacacacacacacacacacacacacacacacacacacatacacacacacacacacacacacacactaagaatgacttacacaaacaatggctggctatgaatggcaggttcaagaacgcagtagttgctcagtacacagggctggatgtcacagagggtctttagattctgctgggctcccgaagaagcaggctctaatgccagggatgtaatggacttgctagcaaggtgagagcaaacaggcaaaagggcaaaggcttccttcttccatgtccttatttagacttccagcagaaggtgtggctcagaatagacctggattagaggtgtgtttttctacctcagagatccagtttagaagtagattaccccacttcaaattaagcagaaatccctcacaggtgtgcccaattattaaggctgggttttagatgtgccttgtaactaattttgtttaatttgaaaatcttgtctgatgatttctatcttcaaacagggaaatttaatccatttatgtttattaagattacaggcaaactgtgccaatttttttctctcttttttgggtcattttacttgaggtgtcttggctcttcttttcgctttcctgtcttctgttgaatggagaattccttcgctggctacaagctaagggttgcattttggttttttgtcatgtcttttaaaatttggagatacgtacttaaccataaaattttctaggaacattgaaagcgacacagtttatttcctaaactaatgtatataatctctagcacaaagcctgccttagaaggcgtaagaattccagtgactcaagtctctcttgctattgccaacactacgatgaatattaatatcataattttgcccaaagacacactaagcattatttttatccatggatatgttgtaaagaagctgagagccatgaatattatccagaagaaattctgtcctgaatagtaccattttttttcccaaacaagggaatgctaggaaagacaggaccatatcgtacttcatttttctcccgggctcatgataacatctctcatgagctctcgtgtttgcaaaatgttatcctgagcttttgataagtcggtgtgtgtgtgtgtgtgtgtgcgcgcgcgcgtgtatgtgtgtaggtcagaggtggatgtcggtgtcttcttcaggtgctctccaccttattatttgagtcagtatctctcactgaagatatgatttgcctattaggatgaggctagactggctggccagcaggacccaggaatcctcttctgctcctaccagagctgaggtcgcaggtgtatgtctccacgcctggatattttgtgtggatcctggggactgacctcaagtcttttgtcacagcactttactgattgagccatctcttcagctcagtgtgtcagatgctctactgtactacactgcaggcacatagtaaccggtggcttttacacagcaatgaactgaacttccttctaaaagcatcccaattttgactagttcagctagaatctgattctgcacctgtcatcctgacctctgacccaaggctggggctgctccatcctgctctggcggtggctctgcctggcaagtggccccctaagggtggtgaagtggatctctatgattctgggagcaattgctggtgaatcaggagcacagcaagggatggagggaagagtgaagtagaccttttctgtggaaggtgcttttacatgacccattaccttggcgacaattctccatcactgttgtcccccagtggctgatggggagccaggaatccatagccctgcagtttttgtcatttagatatgccatatgttctgcacctgaacccccattgttcatctgggaattctgagtgaggatgaggtggcagtgggcctcttgtggctcgtgtctttcagtggtcctggcagcacagatagtctgagggtggcaggactcacacctgggaccactggctgaccataggactgagaattatgacaggcatttatgtacactgcccagtgacaggggctgccaatctttaatagatcctggaatggcaagagctgggaataagatgggggtgtgatgcattctggcagagatgggtactgtctataaggttaccttcttagcctcctctatagcttacccataattcactaggcaggtgtgttggctaactggggtagaagagtccatgtgctcttggacaagccactcaactatgggtgctttgtcaccttcacaatgtggagttacttcctcttactgcgcccactcacagatggatggagaagaccagtgtgagaatagccttgcagactctggaaggacaagagtcgggcaggcattgttccttatctgggcagggagcaggtaaatggatgggggaaagacccagaatttctagctcttctttgaaaccctcatcttcagcctgtgttacatccatccatccccacctactaactaatgcaggactaaaaatggtgacatcagggagcaggtcattgtgtgtcaaaggctgcctgggcttagcagtacctgcgggtagctgctgacctgaacagccagtgctcacaggtagggcacagcacactggatcccatgtgtgaacctagaaccatgccctagacctgctccctccacactagggtcaaggggtaacacttgagcttttaatgtttggaggagacacagggagtccctggagctgcctagagaaggagctgcccaagggctcatgacattcaggactaaccatgaatgtggatggtaaatactaacttacattcatcctggagtctataactgatacttttacagatgcacttgaggaaacaggcttggagaagttgactttgccaagtccatagagctgataagcaggaagcttagattttaatgcagataggacatactcaagatttgactcaaggatcaggaaggttctacaattggaagaggttgttaccaaggaggtcctcattgctttgcagtagccaaagatcctgtcaaggaatttgccccatgggagtgctgtaggttttcctgggagctggtgggatgaaaatagatacaaatgtatgaagagttcaatactctccctctccatctctgtctctctgtctctgtctctgtctctgtctctgtctctctccctctccatctctgtctctctgtctctctctgtctctctgtctctgtctctctgtctctctgtctctctctgtctctctctgtctttctctctctgttgtacagtgcctcacaaaggttcagactgcccacagtcagttcatttgtcatagtacctagcacagaagaagcctgcctgatttgtcaaacaaaacaaaaagaaaacaacagacccatgcacgtgcacacacccccaaaccccaaaccaaactaaaggaaaacagtaaaaaatgttcagggctgcagaggtgctgactgctctttatgatccaaacggcccatcatgatgatttgggcgacaggggaagctggctggcttttggactctaatggctttttaggagttgttatattcttaataacagattgttcctaggctagtttttaaaattatagttcataaaaattatatctccatttaaaggcagatgagaatggaaaagagcaagaggcagtgagtggaacggagagattgtaagtgactccagagacagtcccactcaaggacagaagaggacacaagctctcagtggtttcttactttgtggtggtcctgagactgtcaacatgcacagccaccctctaggttaacttgtatcttaggtgatgggaggtccttcatgtgatttttgggtatttgtctgtggcttaggggagagctggggatgatgagctacctcagccttctctagggccactgacaggaacaattcatagggttggttcagacttgcttgattgtgtcagaaaagcaggggaggggtagagcctgccatacagaagcatactagaggcagtgaactatttctctagtcctcaggattcctgccttcagccttggctgtcttacttctgggatgctgtcatacttttgtgtttgcaaacgaagcaagtcctgcagaagagaaatgacttgtctaaggtcatgtagccactgaacagggatgggaatctagactagatgcctcagattctagggttccattccctatatcatgtaggctttggaatgaattggcttgtcagtgtttcctctagatttgctgtccttggagtgaagaatatatctgaccttcctgatgcctgtgtggatgacaagacttgttagggcaccagagacccactgacaatgctcagagattcacatagtagagaaggcatggggttttcagggcatggctgatcagcctaagactgtcgactacatatgtgatatccatcagaaaatggagatggagacatttactcaacacatatgcacatacacaggcacacacacacacacacacacacacacacacacaccacatacatacatacatcacatttctgatgtttcacgcagtaaaaatttcaacagaagttataggattaattagtacggatggtagcatcacaagactgagagtggtttaggattgtcaggataacatatgtagaggacatggcagccttctgggtccctttcaacattattaggctgcttgggctggaaagtcaatgattcacaatatcagctgatacttccctgtgtttatattttaatacttgattttagcttgactattgaccatctaggttactctttaaaatgtcatttgtttctttaataatattttattatatctatctatctatctatctatctatctatctatctatctatcttgtatgtaggggtacataaaagtgccacagtgagcatgtgtgtgtatgtgtgtgtgtgtgtgtgtgtgtgtgtgtgcatgtgtatgtatgtgcgtagtggcaggaggatgacttgtagaggttgtctctctcctttaacttgtgttggtcctggagattcatctcaggtttggtcacaagcactgttacctcttgaatcatctcactggtcctgtttgcttctctatgtggctctgttgctttatctccaaaaggaagatactgtgaagacctgctgggaccatctaccactgccacggtggatatgaacttaggaaatcagaaccctgccttcaaaccattaagttcatggcatcattttctgttctgaacatgctagtttgagtggaccgactccctggattacaggagtaccaaatgggagaagaaatagtaatttgagtgcctttccacgagccaagcatctgtgtggagcacctttcctctgttctttttgtttacaggagggtctctcctctcttgccagcctctggccctcctgagaaccctctgaaagcacacttaaaggtctctggtgctggaatcaagggggatgcctgttggaagatccttctgcagctggcatattgcatgaccaacaggggagtttcttcctgctgagatggcggccagcatctctccccacaggcaggatttggtgcatcttcttgccattgctcctcctctggactatttctgatgcttattgacttgctgctggaaaacacttcacagggataatgaaccaggcagttttcctcttcatttttctttgttgttgttgaatacatatgggtaactggggctctcctcttacactttatcgattcctgaatttacgagatagtgctgtaattgacaatttcatcagtgccttatgggcagaaataagtgtaggacctgtggctgctaactctgcatgaaactgggacattccaggtctgatctatggcccaagatggcatcacttctttccaactgtgccctgacactgctaagtgtccttgggcatgtcacaactgccctttcttggatctggctttcctttactggtttatgagatgttatataagatgaccttgacagcagcccttgagttctggtttcctgagttccagtctgagacaaaagccctttatgttggtggttctgtgtgtgaaagcttgggtatctccgtgtttcagatgatattcttgatccactcatgtgttcttgcctttgttttccctgggggcctgatggatgtggctgagtcatgtgctggcacagccagaatcccttgtgactaagctatgtgtttggggagagctggcagagccactgtatagcatctggatggagatagcctgactctagcattcccctgatggggaataaacctcaaccttgttggcacatagaaatagtacctgccactgtttttcacaggtcaggactcctccaacacacccttctaaccatgcctgtccactggctacaagccctgcttatgaatacaaggatctgtctccttccagattattatggaaaatcttgctgtcaagttcttaggatgggattaagtcaaatgtgtgacaaaggtcggtgcttggcttttatcccacctatagcctgcagacaagccagacacttgcttagaaaagcaacaatgccttgggatttggaatcagacacacaaatgtttgaagctggcttcactacagttggtggagtcacctaaacaccagcctctctgccactcagagtgtattttctaggaaggtagaaaacagctttgatctaatgacattgccgtgaaaaccaagtgggcttctcttgggatctacagctccaccaagccagtggtgtacaagatgctgtggggaaggccacagacacgtttctttttatagtttgtgtgtttggatgcgcttgtgaaaaaatagaagcaacacttttgagctcgtgatttcacagatattattgctcaggacaacattattttgaaaaaaagaatggagatagttttgagttgatttaaaggacaataggtagagcttattagaacagggcaagcagacatggtcaaatccagcaagatggtcactgctgttctaagtggttacaaatgtctagtgtagacaacacaataggaacagatcaagatgtctttccattcttgtcaattcccggaggaggggatgggtacttctgtaagaaagcacaagagcagagaccagcagtggacaaaccctgtacattccattagcctagcaggggattctgcctggtcggtcgtccaggcacttgagggttgccatagcatcggagcctgagagctaggagaggtcttgaatgtgatctgttgttttgtgtaaaacttaggtggttttatacacagttattttatgaatggaaaactgatgaaaagacccagagagaacttggcttgcctaaagacatagcaataatgacataggtgaagtgatctttctgtcttctcctggggaagacattatttcctatctggcttcctattgtggtcagcagcttctttgtttaaaggtcttagtgcagacctgcctgaactcagatatataatcctatctgttctccatcactgtgggtcctctggccctcacatgctagaaagaggagtggacagccagctgtgagaagaagcaatgatctgttaaagtctctcctttagtgcctatgatgttgaatcattagcctgcgagccaggatgccattagcctctgatttctcccatctaagctctatgcatttaggttgaatcatggtgggagaggccagtgctaggttccccctataaaaggagttgagatggaatctgaggccaggaagactagatggaattacacagccaagcctcactttactctcaaccatgaccatgacctccctgtctcccaggtcattgtactctgtgtgacgtttttcagtttgaaagtagaggtagattgagaacttggacagagtatcttgagagcccagtctcatcccagcatatcctatgtgcctcagagacaccaacatcatatgctaggctcctaaggcctcccaattgcagcaggaggctgtgtatacagtgtggaacccatgtgaaaccccagggcctaatcaacagaatgtttgatttcctctcttctgtatttcttccttgttacttcctcttctctcccaccagcctcaaacctgtctttttctaagtggaaaaggcccacggatggattctccttggcataggaccatagagaactcttgaactctgttatctttccgggaaggagaggatagagaggtgtgaactccttcaacagatatcccattgtccctagaactccctagcttatgggccgctcatggtactttaaggcctactgcagaggtgacctgctttcctctgacactggtgtcccagggtacctcttcctacctgatgactgctacaagacagtgtatctcctctccattgtgtgagtagcccacaaggaggacactctaccctggcatattagctgctgatccaaaagcctctattactctgtatgactgaaggtgaggatgctcagagaatggtgtggcctggccacagatattgagaggccccctatggaagtgaagaggtagctccaaacgagtctgtcctgtggaagttggctccagtgattatggctcacaatgcaaagctgggagggtgccagggcatgttaatactgcatgaggcagtaaggagacctgggccttgaaaccagagatgtggcctagaatggaactgaacagtgggcctcctcttaaaggggcatgacgtgctcacagaggtatgcagtggcattatttccctctaaggctgctcgctatatttgcacacaatgcttccggaagggccggggccatggattaaggaaggtgttttgagggaggcactgcctgactggatgattgtcttgttgttttggctagtgactgagggggagaagttgaaggaaagtagatggaggaggagaggaggcaagaggaaagagcaagaaaggtagaggagacgaggcagagaagggagcctgcaggatcttcttggattctgccacagtcttagctagtaagcagattaagaaagggtagagagggatggagctcagaaggacccacatgaccgattctggccttctaggtgctgccatccacgttcctgctcctttccttcaaagcagggctgagggtctgtccccatctccgtggagagggtctaggcagtgctgtttcctttgagaattccctggctgagtccacttggccaggatccaactgtttaaagagcatcaggataccaatggatcacagtcaggatcactgatgtccaggatttaggtgaagggtggcctccatctgaggggtgcctcaggggattttctaggcatttggtgttaaaagttctccagagggcttgcattctttccaaactggtggctacctgcattagttaggatgcttaatcacatcaacttttggaaaacaccaactctgattagcttacagtttcccccgtagggagaacataaatcaggggagagcaagtgcttgtgcaagggttcagtgatgttggtgaagccctgggtgcctctcttcctttattctggcattcttagaggcctcttgttaccattggttggcacctatgctgagcatactcgtattcttggccttgtgtccgaagatttgacattaaaagctcacatgcatttataaaagaagcaagataactctggagttagggcagggaggctggattgctcagtggttaagggagtgctgttctcaaataccatcagaagtaaagctgtaccgtgacccacaccgatatgtcagtactctggcaccttttcttctttctctggagctgggtctctaggtatgtctggaattgggatcccagagcatcatatgccggtgtgcaacattttctaaagccagcctcaggatcctatgtacatttgagtgttagaaactcctagacctgtcaagatgcccacaggagacaagggaagctgtctcagactcaaagcgaacaccatctgcagtcttggtctttgagctcttgcaggcttgagtgtgtggtgcaactcttggagcctctttttgtatcacagggaatgttcttggctctttgatgactcaagctttccagctttccttttagcatctcacatgctcctggggtcgtctttcttgttgtgggtatagagcttgggcagagcctaagctctccagatggggagttttgcaacataaaccctattcttatatcgacttctcttggacattgaagggggaatataatcaaatcatctatctacctatccattcaccagtccatccatctgtctatccatccatctacctacccacccatctatccttctagatgggatcccatgatttctaggctagcctcaaactagctgtataacagagggttatacagtctctgaacttctggtctctacttcttgagtgctgggcttaaagctgtgtaccatcaggtccattgattgatgactggtttatttcctttgaagactagatctactgtaaagcccatgatacttcttcaaacttcaggaaaaaaaaaaaaagaacaaaaccccccaaatcaccaccaccaccaccaccactaccaagaattcctgagtgaaatcagacatcagatcttccacctttcctgaagacagtatttttatagagaaatacataggaatgcatgttctttcattagcatttcaatactccatctctcctcccagaccccagccctgcctgcacattgcccatgtaggggttccccactaatgaatcctctgttttgttttgtttatttatttatttattagatattttctttatatacatttcaaatgttatcccaaaagttccctataccctctctccgccctgctcccctacccacccactcccacttcttggccgtggcattcccctgtactggggaataaagtttgcaataccaaggggcctctcttcccagtgatggccgactaggccatcttctgctacatatgcagctagagatacgagctctgggggtactggttagttcatattgttgttccacctatagggttgcagaccccttcagttccttgggtgctttctctagcttctccattgggggccctgtgttccatcttataggtgactgtgagtattcacttctgtattttccaggcactggcatagcctcatacaagatagctataacagggtcccttcagcaaaatctttctggcatatgcactagtgtctgggtttggtggctgattatgggatggatccccggggtggggtagtctctggaatcctctgttttagctcttgtctttgtcttctctgatcaccttcattcaggcgatctcaaagtaggaaaagctgtgtttaccaatggcttatttacctggggtaagttctagttaataacacattttgtttgtttctattccccccccccaaacttggtgagtcccagtgcaattcatctgaacaaggtgagaatatttaaaaagcaactgttaagttcctagcattctggtagatactgtgtgtttatctgtgctattgatgacatattttggtgctgatgaggctgaactcatgacttctacagctgttctaggactgcccttgactctactgcttagatggagtggtggcaatgaggttcagtggggcaggcaatgcttctcttctctaggatgccctagcctagcagaggagatgagaggtacactagtgtcattttgatcttgatctgtgtggaagccgttgcttgagagatttctgagcaggagagagccaccccacccatggggagaagctgtggagaactctgcacctccatgggacctgagcttacacactgatgggaaacatactatgttttgtggcgtgtgctggggttaatctgtgcggttcactggagggaaaggccatgggttcagttgaacccattaaagctctcagtgcttgcggtatttttatgctcacagtggaaagacagagcttcacatcgactgttggctgctctgagactcatttcttgtgggacctgtattcagcagagcgcaaaagtttggataaagacagaaataggctgaacatcagccccgcccccgtccctgcttattacagcccttcaggagtgagagctgtgaggtgtgagtgaggggatgttgggaaaatgctctaatttgcttctcctgtctcacattcaacttagcacccttgactgtagcccccagcagctacccagttctaagacttctggagacttgaggcaggtaaggggtgttgaaggggaggagaggcaaactaaaaagcaaaacatagcggggggggtgggggggtggggtgggaaccaacacgactaggcaggtgcacatagtctccagcctatggagtgccctgaccctgatctggctttcctaagatggaagaggaggtcccctgaagaaggcacctggaaatagctcatcagaacttctaggaaggtctgggatctctttaaggttccccaaaatcaccatagagagtgaggacttagaatttgggtttgactagtgataactaaggccaggggtttgggatttataagtctggggaggagagcacaagggtgtcttttatctatccagacttcactcctagggcactggggtgaggggaggcagaggctctgctgagatggcaacaacctcaagaggtgactagactcgctctatcagacaccttctgtgtgctgggggctaagtgaaagacttcagtcttgagaaatggttctcgggcaaccacaagtgacaggtaaggaaacagacacagagagaggctaggttgccttagcaatgtcactaactcagggaccctggttccagaggtacctgtgtagaaaccgaggaaggcagatgagagcaagtcaaggaagtaaacgaatgggagggagatgggagctcagagaagcgtcctgagctagagatgttcctttctttccgtggctccgtagagaaaatgttatttggtgagggggataagaaacatgtctgtcattgctggcactctttacctctagaatgttccactgagcacgtgccgtggtcccgtgtaccccagagcctgtacaagtgcacttctgcctggctggactccttgctgtttctactctttgtatattggtttcttcttccctgtcaaattctaatttaaagtcattgcctataaagcctggcacatggtccatgctcagcagaaatctgtttagcaaatgaaccagaagttctcagggttagagagaataactatacagagaagttgggaagacttttaagggaatctgttggcattttgatgtcttatgtgagttcagagctatagcagtggagatgaggttgaagccaacctggactttcttggtcaagatgcaggctaagctcctatccttgcttttctctgctgatcctgagaaaggctgttgtgtgcctcacaggctgaggctaacgggaggctggagtgaatgtgaaggcttgcatgtgtcctgtagcttttgctgtgttgtggccagagctttcctaagggacacagaaccctctaaacaatagctagaatcatcccattttgaacttttttcttgggttggcatgggaaccagatgcaaactttatctttcctacctgaattgttattttctgaattgccacacaacatggcatcagatacttagaggcttctgtgtgtgccaggcattctgccaggccttttaagtctgccattttgttgaaatcgttcctgtcttcacacaaggacccactaaatggcatgactctctggggacagccctgagccacactggaccttgcaagctatttgttcatgtaaagtccctgccagatttacaataccaccaagcagaaggcacttctcttgccagaagactccaaacttgaacgttggaatattttttcccccgttctatgtgtgaccaagcaagttctggctgttgcagtaaccgcagaattccccctgcttcataatcacttgtattatttattatcctggttattagtaataaaagccataatgattcagccttaaggttggcgaggcagcagcaggcagagcctgacctttgtagggatattaatatactttcacagcctcccttcagatggtccagactcatggaatgagagccagcccctgaaaataatcgtaaaacaaaagaatcaactatctctaactggggtgttgattggcaagtaagaaccaagtgttttacaggaaggccttcaaaacaggaccacatctctggccaacttctagaaagtgtgagacatgaaagcaaggcctgaggagctgttgtttgccctggcctgtcacctctgggtagagatggtgtgtggatagcatcagctgccttagtggggcctagatcttgtccctttcccgaaggtgttgtagcacgatgttttaatccccccctgagcgcttggctggctggtgaggctgcatggaaaatgtcagcctgatggcccaggccaaagccagcatgccactcagctagctttgcagggctgacgtggcgtgtggctggaagctaatggaaaggtcacaaaagcccaggacaagggaagggatggggccaatagcattgccctgtaacgtgatctggaagatgaaattgtagcgtggagctgagagatgcagggctggggaaagagacctcagcattttccatgattaactttctaatagtaaccctgtgtgtacagcgggtgcttagcaacgggaggcatcttctcagagagtgcgttaataaagtgcatgtggcttcccactgtgatttggttttcccctgcttgctggaggcagagagatcagaccacagacctgcagccctcgaggctgaagtcaggaggcagctgagtgtgtctcctttcctaattgagttgtcccttccctggagaatccagcagagcccctcttgcctaaaagtcacaatgaaatggatacttaggaaattcctcatgagttgagagagaaccccagctcttagatttgtatgatatgctgtgatatgatgtatgtgcatgtgcatatgtttgcatgcgtgtataagtttgtatgtgtgagtgcacgcacgtgcacacatgtccttgtgttttttcaagccggtgtgtttatgtatgccagaggttgatgtcgagtgtttttgctttttcatttctcattttatttaagaggaaaaaaattagatttctttattttatgtgtacaagcggtttacctgctcatagacatgtgcaccataagtatgcccggtgcacttggacatcagcctgggttgtcagatcctcgaaactggagccacagacagttgtgagctactgtgtgggtgctggggaccaaacccaggttctttgcaggaggaataaatactcttaagtactgagtcatctctctagagcctaccttatttattttttgtttgatataaatagacttgcagtagtctcaccccctactcccatctcttatcttcctttcccccacaccttctttgcccatcatggctgtttgacaaggcgtgaggacgctcctgtctccaccttggcaacactggtatcacaatccgtattccactcacctaagcttttacgcttggctagcaagcagctcattcactaaccatctttccagcttttagcccttagagatatagagtttatcatatgactatgataatggtttcatgtgctacaaagaatgcccagcctggcgtaggaggacctgggttactggaaatacagaaaaagtcacctatggcatttggggcctgaggccttgcaatggcttagtctgtttcaggtgctagggacccagtgataagataacagacagggagtcattttaacctatagactagtataggaagtcacagcatggtaaatgggcaatggtttctcttcctttgatattaaatgattttgaccatgaaacaggtcatgggggggggtagtcatttgagtgtgtaggtgaccagtcaggttctctttaaggaccaggatcccatgagatatctgtctaaagggaatgctgtattcaggcatgtggaatggcagtggctagagtttaattgctggagtgactctgtccactgtctgcccccttgctgtcttcctccttgttttatttgttcctggggtacttgtcattgttaataaatacctttacatttggcacatccgtgtgcattgtcacttgcttccatggctgtcccctgagggctccattttatctctctgtccagttctccaccagggaggagcccagaaaggtgattctctgcatctcctggcttgaagacgagctgaaaaaagttgattgacaggagaagcgggtggagtcaagtgaggggtgaggaggtccaggcgtaggtgtagagggaggggctggaaatggagcctgtagatgtccctgcccctgtctcactgctactgggaaggtatggctaggaatcaggttcctgggtctgtgagccctgccttgggcatctcagagtttcttgcttccagctgctgggaccccttctatgatattcttgtgtcctataatgccatgatgcttcagttgttgtgtagaatctaaatctgtgatcaaccctgatgtcaaatcagcggaggctgtatttccagaggcactgtatgtgcttatgcgtaccgtggtggctgaagccagtagcatctttgtcctgtgcatctgtgcagaggtcaggcagcaagtgacacagggacacactcttgctcatgatcctgaagcagaggtctcaatggctgctgacgccagtctgtgtttataccagggagttacattggagtgcctgttaccccttttcctgcccttttcagtgcacacacttatgtgtcccttagctgttaccctttgccgtctgccctagcttctctgggactgtgcccatttgcccacatgtgggcagcacctcgaaatgagaatggggaggctctctttcagaggttttcctccccttcgctcacctctcctacccactcgggagagtttccgatctgtacagccacactggaacacagaaacgtgatgaggccggagtggaaagttctgtaggcatcccgtccactgagaaaagcaggagagggaaaggaagggaggagaggcgtcaagaactccagctttgttcaatgctctttagaaatgtctgactccttcatgtctcatgcattgtgtagcttctgtgtgtgtgtgtgtgtgtgtgtgtgtgtgtgtgtgtttgagcctgtcagaggcactggacacagccgagagtaatgcagacagtcctgccttggagagcttggggttccagtggtaggaacagggtaaaaaagacaagatgtggtccatggggaagacacaaagggacccctgaaacaggaatggggagcactgaacatacgaggatgcctttgcgtcccataagctattgtgagggctactgtggtcagaggaggaagcaagcctgagagtgctgaggtaagatggtgttgtagggcagcaggatggaatctccttcaatggagagattagctcaatatgtgtcacttgtaaaatctggtctccccagaacccttggctgtatggggttctcttcgggctggggttcagagatcatttgctttttgattgagttacttggttctgcttggagctgcacctgtgatccacaggctctgggtctggctgcagggttgggagatggaacactccacccttccttgtgtggttcccagctggtgggtgcttaagtggatgcgtgggccctggaagtagggtatgtacaggaggatctgatggtgcggctgctgagtgctgggatggggaggagccagtcttgagtaggggccagcatgaggcgaggcgagccctgggacttgggccatggcacctacagtgtgatttgtgatgattccccttaggtttgtttccaaccttcaagtaagtggagccatgattgctggctgtcatcttggtttagagctgtatgtttagactacagccaggaagacctccctaaggagaaatagaggagaaggaagtcttctgatcttcctaggaccactgacaccctactctgcttcacagggaacaaactcaggttctgcaaatagattggtgttcttggcacagttagttttttgtttgtttgtttgttttttaaattcatcatttccatttatggaccaaagtttttggatacaatatctgggttgttcacttttctaacaaaaatgattgaagatctgcacagatggcctgcatcccttcacggcatcttgactaataggcacaacagttgcaagttaccctttgcccccatgcctttaaaaaacactgtctttggattagggaaacaaatgtgggccttctgtatattctcacaaatgtctccttagctccagagttctgctgacagcccagatgggagccagcactctttggcctctatgctgaagagtcccagtgagtcccttctgaggtcagaaagaagcagataggggcagagcttcaggccgcgtccctgaacaacatagagaacatgtctcccatgtctgtaacaatggcttctacatgtgggtgcatgggataaagatcagaggtcaaggacatccaaaaggctaagcacagggaattggaagatgcaaaagcagtatagaggtggtgcagctttgcaggggcaggtctcctttgttcctagcgcatgctccccagcttctcttttgccttgttctgctcattaagctggtacctagtgtttattgggaggaatagcaaaggtctgacacctgttagccctgagcatcttagattacttcccttcccacatccaggatctcaccttgcccaacctacctgaggttttctaaactgcagtgttaggaaaggcagaaagcttcaagggcctgccttgggcacccacttcctttctagctgatccaggccctaaagaggataccaaagccacactcttggggtgacctggtctaatgtgactccacaaaaatcctgtggcagaagagtgggcagcttgggtgggtgggcatggagaatgacttttgttcccttgttggtacgtccaggattgactctctgtctatttcttcccctgagacttggctagttccaaaggacagaataacatgccttggggtagagtgggggctgctggacctcagacagaagcactgtctttccctctgaacctcgcagagagcctgatgtaccagggtataccgaggggaagccccgtattgctcactgatgttatcaggaggcttctagcctgcgtgccaggcaggtaaattgattttttttttcagtctgtggaacatctaaagataggcaaactggtgtgtgctgctagcattgagaatgacaggccatctgtgaatcacaagcccgcccactgaggttgtgcagggcccaggctggtggcaggaaggaagctctgctagaagtagccagatgcaggtgggtgccactcaaggattggggtgggggtggagggtgggnnnnnnnnnnnnnnnnnnnntggggaaagggagtcagccttgctggtgaatctgggatccccattctggttcccaggaggatgctcagcggctcaacagtactggagctacagtagtcaagtgctgtgtgtgctgtgcagcttccgtagctggatagaacagggtagccccagcaggggtgaagcctccatgtggctctcttgctggttcaaaggcctcacatagccagcctatggctgcttgttttattccatgatgcctttctgtctttgaaccatttggctagttcttaggaggactttatgttttttcagggatttctcactcccctgcgcccccccccccccatacaggcaacacacaccaagttccttctaggcactgggcaaagtactagatacagcgcatgccacagaacattaggcagcagtgtgtgtgtgtgggggtggctttttggtggcaatgtcagtttctattaacctctggaaagacagccagcaaggtatggagtaatggaaaatatttcctgacggtgggaaaggcctctctgaggaagagatatctggaaaggaagccagcccagtagaaattggagggaagaatctctcagtagaaccagtctgtacaaaggtcctgaggtaggatggaaagcagttgctcttttcacactgcacagacacatctctgagtgaagtgtgcagcccatggtgctatgctaggaggtttccaggggctgtttttatagatctttgtaggcaacagtaaggaggttggctgtccatgtcagtactaggagcactgttggagggttttagccatgcatgcaacctcgttagagcttgttaaatctcagtctgtagccgtgaacctgaaaagcaggcaggacaggcatggaagcagaactccaaagcagaatactgcccggtcctggggggagggaatagaggaacaggggctcaggatcaaactgaagccatctcaacctgtatagcagccccactggaggaagaaacaggtcctcaaaggaccaaggacgtgctccagattgcacctatcatcttagcttaaggacttccttgtctttcttgtcttagcgtggggtctcaggatgctaggttgccttgattgtcagacaggtgttagcaaggagccatccctgggaaggatgactgctgtaacacggtacccaggagaggggctagaacagcacagttaccttcctctctctctggagtcccaggtcaaggtgttggtaggacggaagctgcattcctatgagatctgtttccttggctcataggtagcctggccctgctctctctgtgaagtcacatggccttctgtttggctcctcgtcccttcctcctaggacaccagtcgtactggatgaggatttactctagtgacctcgctttgacttggtctgttctttacaaacacattcagtgtctacctcgagagttaaagatgtctgcatatacagtgtggagaccacacccccggcgtgcctctccttattgagccacctcagtgggtggcatgggactcacacatgctgctgttgtcctctgaacactcagcacacttgtttagtttatctccaggacaatggtaggccagtgctagcagatctttgtgggtggccatgtacaagagtgccttctgaggaccatactgccttctgagggccagcagtatgaggtggcagatggggtcggcaaacacaacaggtgtggcatatgctggccccaggcagagagtgtgagcaagagccaacgcactgttttcatttagccatcggctttaaagcatgtctcctataatcacacagatgttgagctgtttatcaggggaggtggtaataaacaaagttattaaaaatagccaacaccatcagttatttctaggtgccaagactgttcctgaacattctgtgtcatatttatcttgataccacagaaattcagtgagcaggtgccacccttatgagtcctatcttagtgacagagaaatgacaggttgggaggggaaaaaaaataactcaactctggtccttcagccaggctctggtagagctggggtctgcaaacatcagagttcctgtcctctaactactatgcagtttgtactttaagcacctgtccccccagctgggttcccagtacttacctggcaccttacaaccacctttatctctagttccagggatctaacgccatcttctggcctatgtgggcacaacatgtatgtggtgcacaaaaatatgtgcaggtcaaatacttgtatgtattaaataataataaaaaaataaagaattttttctagaaaagaatggatgtttcaagttcttaatgagacttgatttttctgtgtgatgccacacaaggcaggcagacttttcttatggtcttgtgtttctcaaaatctgctccatcgatcgacaacttcttccttcagtgtggatttcttagaaaggtatattgtaaggccccagtccagctactagaacagatagtgacctgggacctgggacctgggacctgggacctgggacctgggacctgggacctgggacctggcttggggtaactgactttccacgtaatttacaccctctctctggattgacagccttgccgggttttgacacccctggttcacagtgaccttgttgtactcccttgtgtttgcatttgtaagtctgaggctgggtatctatggggaacaagaacctgaggcacaggcaggttgaggacagaagctgtgtggcttcaagccttcaagtcagcccatgcactcttagtagctgacaggcccaaaggagggttaatgtatagtatatttgggaaacacaagttttccttagtgaagaatacctccctgtaatatgtaatccatcccctctctgtgtgtaaaccagaggtcagtatcatgtgtgtttcttagttgctggagagatgctgagtgattaagaacattggctgctctcacagaggatctgaattcagatcccagcccccacatggcagcttacaacccatctggaagtccagcatcgggagagatctgacaccctagcttctctggacactgggtgtacacatagtgaacatacatacatacatgcatacatatgggtaaaacactcatgcaaaataaaaatattagaaataaataaagcatgacattaactcttatctttctgattgtaaagcacacccatgtttcttgcaggacacccagaaaataagtgaaaaggattagatgattattatccagaagtcagaataataaccaacgccaggaaggctgtatgctggaaccctggctcactgctagtggagtgatggtagctgcttattatattaggcactgaattatcatccggtcccaaagtttcacagaaataaaaacagggatgtaaacaggagtcagggggaagtgggattgtaactgagactttggacgccttggattagcccgtgggcatgtggttggagcattcattttaaacttcaattgtttatcttgtgtgtgtgtgtgtgtggatgttttatctacatgtatatctgtacactacctgcatgcctgctattcatggaggctagaagagagtgtcaggtccactggaggtggagttatagctggttgtgagccatcatgtggatgctaggaattgaacccaggtctattgaaagagtagccagtgctcttaaccactgattcatctttccagctccagtgggcctttttcttcattccccatatccctgtgggcagagtcactcatgggcaggcgctcctgggttatgtaagaaagcaggctgggcaaaccgttgagcagcaatcttccttggttcttgcctctctctgtctctgcaggagcttgtgccctaactgccctctttatggatttgggggatggagagagatggctcttgggagcttgctggcccaccagtctagctgaaactggagccccagattcagtgcaaggcctgtgcttacagaataaggtggggatcaataggggctgagataccctgctgggactctggcctttgcatgtgtgtatgcacacatgacccacatgtacatgtatgcataccccatgacacacagaaatatagaggtgagagcaccaggtacatagccaaggtgatatgtacagatgttttatggtattttgtaccaccctttccttacaatttctttccattttgttagcagaacctttggggtgtttgtttgtttgtttgttttttgttgttttattttgttttgttctgttctgttttgttttgtgttttggagacagggtctggctgtatagtccaggttggctttaaacctgtgctaatcctcctgcttcaaccaggattccatgcatgtaccactgtgactgactttgaaatagcttgttttctttctctttctttctttcttccttccttcnnnnnnnnnnnnnnnnnnnnttcctgcctcagccctctagcatccccttcttaactgtctccccatgatagctggttctttcagtgatttttcagtgttcattgtcctaggttgggtgggttgcagttaaggtctgtctgtgccttggatacagtcctaggaaaggagtccccagaccaaaggaagaatgcatttttaagatttcttcatcacgttgccaagtcgctttgcagaaaggctgcacagcttacacaaagcctccacccaaagtgggagagaaaaagcagccttttggaagggcactgtctcctttcttgaggactttgggggtggggtggggcgggtggggaggataactgagaaggaaaggcccatccccagccctgagagccgaggtgctgctgctgtggcctgaagcatgtgagtgagtgcttctgtgctgagctcggacaaggctgattagcgttcagccactggcctctctgcccacgggaaagaacagccagttcacaggtaatcccttgatatcgagctctggttccagtctagtgatttttatctaggctgattgcaagttcagccctggctgggccagggcgatgcccactcagccctcagatcccatttcatggcaagcagcagggcaggcccctctgtctttctcccgtataccctgagatgcaacatttcaaggaatgagagcctggtttctctggctcgttctccaactggacagggcgagaaaccaagtggaaagcaccttcatttcccattgctcttcctcccaagcatttgctcccccttgcgttttcaaaagcagtttggttgtgtggagttgaggtttgcaacatgactgtgtgagatctgttgaaacatctctggcagctttcatagtgacaaaggcaacttatatttttcattaaaacagaaacctttaatgtgtaagatctttaaaaaataaaaaagaacactggacataagatcttttcaatgtgtctactctggtatcctttgacctttgacctatactttataattttctttcacctcctccctcctctgctggaaaccttcatttaatattcactgtggattctagttctctgtctgtctctgcctctgtctctgtctctctctcccaccctccctctctcctaccctccctctctccttcccttcccctctctcaccctctccactctctctctcatatctatttgtgtgtgtgacatcatataatattttttcttgtcttactacacttggcatactgtcctttgcatccatccatgttgttacaaaagccactcaccctctgaaaaacagcagaagcccagttgggaacatgcttgctgtacaaacatgagtttgagccccagaattcatgtgaaaagagctggacactgtgcccatgcctgtgaccacagtgcagagttagaagcaggggagttcttgctgcttattgaccagcctggcctacttggcgagccctagggtaatgagaccctttctgacaaaaacaaaatgggtagttcctgggggcatgacacctaagattggcctatggtcctaaaacataggtctctcctgctccctaacacacagaggatagcaaagaggccagtgggaagaagtgggagagaggagggagagggaggagggaaaggagtagagagaaaaagaaaacaatttagaagttacatagaggttttttttttttttttaaagaaattttacttctttttggcagattatagaaataaaatttggcttcccacaacccgttggagaaatagcattctgttcttattttgagctgacagcctaaacattggtctgaattgaatggaccactctggaatgaagctctgtgannnnnnnnnnnnnnnnnnnncccctttttctctttatctcctctcttcttccttacttccttaccaaattctgtatttaaacaaaccctaatggtgtccatggcttctcttggtgaaggaatctctgacaagactccatcttttgattctggaatgttctggaaagatgacagacaggcagagtgagttaagggcccaactctgtcctgaggctccctattggtacctttaattttgcctgaagaaaatataattagccctccatgtgagtctgaggggttaaatttaccaagagtgacaagggggtggggctactacatttcccaaggaaatggtttttagggttccctcctcaatgtccagaccattgcagtaggcttccaactgggactctgactctcctgtcccaccagccagctgggctttcagaatgctggcatttcacattcctcattgatgattcttccataaggcccttgctagctgaagggaaacagaaaccccaggtttcctttcttggaagccccccccccaagggtcttcataatctcttcctgttttctctctgtctttggactccagcccactagctgctttcttctatttattgccccttggcttagtgagtacccttttgcttcgttgtttgcttagcttgaaatcccacttgtccatgactagctttccccaatagcttgattctgatcttcaacctctttattctaacaaatcagctttcctttccatagcctctacaccatttcctctttctcaaaactttcatctaaatgccttctgttcaggcataaagtctgtagactccaaccttgcttcctttcagtttatgaagccctggtcccccgtgagtgcttcacattgcaggataaggtacctaggtcagtaacctagaaaggttgatccattaatgacccatgactgaaggagtcccatgttgacaacttttatctccacccttctctgctgcttggcttgcagtaggcttcacaggcacctcctgttgtattctagcatggatctggattggcttaacccaagcacaaggcaggtagcgatacctgagagaggtagaaagggagatgagctgaaagactgctgactcagctgccaggccgggtctcttctgggctctgagtcaatcaatgagtgatggccacaggcttgtacaggactccagtcttctagatctgtacttctcaactttagagatccgcagcctggggccttctgggtaaggctcaaagacccagtattaagacagctcattttgctacagaaatagatcttctgcaaagcttagaaatggatgtgttttaatatggagtccactttaacacagcatggagaaggatgagattcttgtgcatttagaaaaatagacaatactctagacttttcctgcagtggaagatgcacatccttgcttccagctccaggctgtaccagaagctaagagagggatgtttattctttgctttctggatatgaatatgaaaggcatgagctggctgaagcctttttcagttgcgagtttccccatctccagccccctagccatggctgcttgggtgtaagatacagccggtggctacaggttagacttggaggtggatggagctgggttcagattcctctagctgtgcagacactgcaggccgaggacaaccgggggagggggaggactttaattttttaccttctttccaggagagagaaatgaatgctgaatatgtgataccactgtgaaaaatgcatgtaatttcacagctaggtccccgtgtcagcatcagcagaagaaactagctcttgtgagtcaggaggataacaaagacgggacaactgggaacaatttggttgatggtgatggtagattggaccccgacaaggagagcctttctatccagcagcctgtgccctgccctcctgtacctcccacaccttttagataaagtgaacattggcacatgacacgcacctcccgtgctgtctgaactgttaaattacaaaccccctaatgcagaagatagttgcaatgacaactccagtaggatgtgacatttctgacacttgatttcctgtagctaagggggtgttgaccccaacagccatggatagtctcacagggcctactgtgagtacagatgtgggaattaccagccatttgcttttgtagggttcttagaagcagtttcaagggtagttttggtttttgaaacaagatctcatgtggcccaggctgaccttgaactcactgtgccatcagggatcacccagaacttctgccttctgccttcacctcccatgttgggattactggtggatgttgtcttagtgtttctgttgctgtcaagagaccctatgactataaccactctttatcaaaagaaaaacatttaattgggactggtgtatagttcagaagtttggtccattattcttgtggtgggaaacatggtggcccataggcagacatggtgctgaagtggtagctgaaaattctaaatctgaatcagcaggcagcagggagagagagtgagagagtgagagagaagcagacagatactggacagggcttgaacatttgaaacctcaaagcctacccctagtgacagcacttcctccaagaagggtacacgtgctccaccaagaccacacttccaacagtgacagtccttgtgaggctgtgggggccattttcatacaaatccagttttgtggggtgatgggatcaaacctagggtttcctgtgtgatagggatgctctctaccaactgagctacatctctagccctggatggtaggttcttgagggtaggggaccgtatacaatggcatgcacaaatgtgaccaggtgcactgtaggtactgggagtggagcatatgagttggacacaggcagcagatccgacagtgccctcagtcaactggcaccagtgggtcttctcagaacctttaggaaataaaacattgtgaatttatgatcccattaacttaaaaaggagttactggacttttctggacccttattgaacctgtaattgaagttttggctctatggactaactctgctgagtgcatggacagactttacatagaattgttttgtatataagtgatgaaatgatcatacaccccaaatctggtccaatagggagaagtaacatgattgttctaaagatctgacccagtgctggggatatagctcagttagtaaaatgcttgtgtagcatgcattaagttttgggtttggtccttagcactgcataaactgaacattgtagtccgtacctgtaatcacagcacttaggaggtagaggagtaaggatcagatatctgaggttaaccctggcatacatagttctgggtctgggcctatgacttcttttcttctgaggaaaaaagaagaagaagaagaagaagaagaagaagaagaagaagaagaagaagaagaagaagaagaagaagaagaagaagactcaattcagaggtagtttttgtttggaaagtagattttattattacatttttaaaatcagaagtctgttttgcccttcccctgaggcctagagggtttagaccgatacactgacagtatcttaaccaaagaggcactgtgtcttctgctttaatagcattggcaggaaaccttgggaaattgaatggaaaagcctacatttcatgccaatggaatataaaccatcattattaatctcatcatttttaccaggtgccatcttatttaccttatattctgcagtcttggggaatgaacccagggtctcactctacagacgttctaccactgcccccaacccttaaaattaatatgtatatgtatgtgtatatgtttatgtatgtcattttgacacaaagtctctctacactatcctggcgggccttcagtagattctgtacagagaatgtttggccacaattgtgatctccttgccttaacctcctgcgtgctgagattagaggttgcactgccatgctccagtggttggacggtaggcccatgatatcagacataatcagttcacactgcattggagatgcttggagcttttgtacatatgatctcatacaatcctcacagtggcctaggaagacagtgattattatcattgcctttccccaggagggtaaactgaggaatggtgacactacctggcatgcccaatgcaaaggaagggtaaccagttgagggcaaatttgaactcagttaaggatttccaaccctcctctgagtgtccacagcatgctccacagagatgtgacctgtgggggttcaatgttttcttatagagcagactatatataggaagtataacaatatactataaatataagaatgtaggctgtaagtataaggatgatcaagtcagatgatcagtgggtaaatctggggtctcagtcctccagagaatctgggttgaggatggccaagggagaggaggaagtttacacggagagcttcctggagcaatgaactaggcacaaggatcaggtgggtagccaacggtagggacaggcattctaggagaggaaggaggagagaggtaggtggcttgagggctggcctcagtctccccatcttcctcggcatgagtgcccatgaatgaaggggtgccgaggtggattcccctcggaaaaatggtgcagcagagaagaggcacgtcagctgtcaggtgacacgtgggagtgtgtggggagcacgcctcatgattttctcttctcccaggtgtcttactgctgggttttaatggcaacactaggcaggcattggaagcttgcttgtgacatcagtgctgcttgaagcatctgctttgcttcctaggcatcttctagcaaaagaggtcatcctggtgatctttgtgggcacttgtagctatgtgtgtgatctaaccatggtggagcacagttggcggctgagaaatccatgccacaggtcagacacgaattgcattcttatgagtcagcttccgccacacagataatttgggtttaactaggacacacctgacctcagtctgcttacaggtgcagtgaacctgttgtgtggtctcagcgtcagtctgccctgatcccttcctatgtgggtggtagtgcctgtttatcactccttcagccagagtgttacagtgagatgctcactgacagctccctctgatttctgagctcagggcagagaggaggagccttgaatgtaacggttctttccctcccacctcagtgaaccctcttctgcaccaactcctccatgcccccggaggatgtgccacctctgccccctccaagttcatttctgtgtcagggctggtcctttgcctattgcagaaaggcagtacaagaagcctctcagatagggcgtggggtgataacttcctgtcctctgaagagaccagcctcagtcagggtaggacactgcagatccactgtgctgcaagtggggaggacctgggtggggaggcagagatagaggccgtgtgggaggggaaagaggcagagatgacaggatccgtgagtgagtcaccagcttcaggctccagctggagagccccggggagggggaacaacattgcctaatgcagcaggcaagggcccagcttgggtctgcgatctgctcttagcgtgtgtgtgtgtgtgtgtgtgtgtgtgtgtgtgtgtgtgtgtgtgtgtgtgtgacattctcctggggcatgggcacagaggagtgatctgccttacacttggaaagcagagggaggtgtaagtgagcactcatactacaggcttgaacgaaccatccacacacaagaggaaggtgctagtgttggtctgttcaggaatgaagaatctgagaccctgcaaggctgagcaaatagaagtcccgaacagtggtaaaatactacatgacttagctctggccctgctgaagccttggacttcatcaccgcagatggttgtcagcccagagccagcaccagaagcacctgggtgctggttctagaagagtctgagttatgcttccatgtgagagctgtgccaaggtctgaggttccctgttctgtactctccttactcagcttcctggcccagtttctccatctgcaaaagactctaggagcttggcatctctacatgttctctccagaccactgcttaattgagtttcccacgaatggcatccttctcaggcatcacggctgtatctagtttgagaacctagtttaggaaaaacagcagtaggtggagaacattcagtggtttttcttttgtcatctgctttgttggtgtggaaaggccctgggcttccagatactcattttggattgtactcttattgatatgaaacaccctgcattctcttatgctatatattcattggaaatttctctctgtgtgcatttatacataggcatatataatgtgcaacacatgtatgcacattcatatgggtgcctaagtatgtgtacagctacatcatgtgtgcacagatatactcggtgtgtgtgtgtgtgtgtgtgtgtgtgtgtgtgtgtgtgtatgtgtgtgtgtgtgtgtgtgtgtgtgtgtaggacagaggtttacttttggcttggttactaaggtactgcctactgtctccagcttgattgaggaaggctttcttatgagtctagagcttgcctggcttgagcagcctggctgggcagtaagctcttgtcattgtctgcccagggctgggattataaggcatgtcattatgcctggctctttatgtctgttctggggattgcttatcacttatgattttgagacagagtcattctctgtgaccaggctggtctcaaactcttgaccttcctcctgaggctgtactgacttgtgtatgctcctctaccctgcttctacaccaccctacttaatatccattgccctggattttactcgccttgactctagtgcccccattctggcacttagtttttggctggcatattttgggctattcttttactttcaactttattttattgtatctgtgcaggatacaggatacatttcttacacaaaacacataattgtatgcattaacttgctgtgtattattctatccattttatacttcataaaagatgtcatttatttttattcttccagctaatacattttgttcctccccctttaaatggttctctacagcctccgttatgtctttgtaatgggacattttaaaatttcatcttatacttctctctagcaaatggcaatgttggctctacctgtcttgctccttaggtgtgaggggtagtgtttcgccttattctgctggtggcttctgcacagagtgctcttatggcttttttctgccacttcacctctgagaacattacaattatggttgtgctttactgtgtgggctgatattttaagcctctattgtataggtattagattgtatttattatttttatgatctcatcttctcctaagtcttagctttcgtgttcattgttatttgtgatttgagagttatttaagcttaatgaaacttcaggctcatggctaaggttttgttctgtggacacttaggtctgatcagtgtcttagctgtgcatatagaacacttaccacctatggaacattctggaacaattgctctgattcattgctctttcctctgcttttgtggcactgctagggatggaccccctccaggtgaagctaaccccctgccactgagtcagaccctcagcctctacatttcatttcttctaaggtttacaacagtgtgtggctccacagctgtattttgtgaattagtcagactcaaactgatctttcttcctttcaaaggttaactgacatcttctgcttgggtgctgtggaacgccaccatggagtcagcagacacatctgcttaattgtatggctgttccttgaccttcacagccaggtctaccctatggtctgaaaagtggttttctggttttgttttgtttgttttcgttccccccacttagttcggtttataatggtctggctgtctaagtctgttgagtatgatctggaatccagctttctcagtggtctgcctctctcagaattcccctccttcctctcgggagtatttgtgtatcaggtttcaggagcaagcagccctggctttggctactgacaggggactcaacgcttgagtcctttgctgaaccctgtgctgggtttcttacctgctgtatgttccttcttgagttggtagagtgaggctaagagtcatgtgacttggttgtgctcactatggattgaaaaatgtgtgctgagaggcctcgccttacactgccccatccaggcaccaagaggcaggtagagcctgtgctctggctgtgaccataagagggttctctgaagtcattcttttgtttttctagacttatacttacttatgtgtaggtatgtgtgtcgtgtctgtgtatgtgtgtgtatggaagtcagaacagagtttcagatccccttggagttggagttacatttggttttgagcagccaaatatgggttctgggagctgaactcaggtcctctatgagaacaatgagagctcttagccactgagccatctctcccttccctgtttgatttttgactctgtagtccaggctatcccagaactcactgtgtagtcaaagctagcctccttaaagcagtcctgctgagatgacagggtgacctctgggtgaccaacgaagcagtcatcctgttccaatcctttctttgagttctgtgttctctgcttggatgtttacaaatgtctttagaggattgatggctgctttttgtggcttccatcatgaacaccgtcatggtttgcccacagtcagggaaggctgactctcctggacctctttgctgttcacctcatttcaggagaacactgtgtggttctgccaccagatcactggttaaggaaggcatctcacgtggttcagccacctgtgaggccaccccagagagccagagccatctgtaattccagtgggagctcaacctcacaacacttttctgacttggtaaagccactgctctgagtgccaactgttttcctctggcttgctgtttgacttggccaccatgccaggtacaaactgtgctcaaacttgtcctccttcctggagctgccacctgctgtgtcagggacaggccccttatcctcagccagtgttcttctgatataccagccatgtgattcttggggcttcccagttttgctatacacatacacacacacacacacacacacacacacatacacacacagagagagagagagagagagagagagagatacatactggcagacacacagatatatctggacatacatacacacacacatatatacacacagagatacacagatgaatccacacacacccatacatacattcaaacacatatgtacacacacatatggggggagacagaaacagagacagccagagacaaagagacagagacagagagacacagagagatagatatgcagaaagacacagatacatccacacacatgcatatatatatgtatatgcatatatatatatacatatatacacacacacacttccagatacacccagacacccccgacaccccccctcacacacacttggatccacaagggcaagaggactcttgctatgactacttctctcccctagcctggtttacctcctttggcaggtcttacttatctgggcagctctgttctttcttagtcagaaaggatgaccaaggtagccttcatcttctttattcaaacatcatgctttttcttttatgtttggggcacatggatggcacaggtttccagcgtcttaggggtatttcaggctttctgtcttcactgggcaactgctttccttggaggtttctcagaggaacattctagatgtagatacatggaagcttagctttctcatctatcatagatctttctagaatgcagaagctgagaggttatgaatacttgctagctaatatgcttattggtccatatcaaaaagagaaagtcacaaaaatgtgtgccatgtccagcccttgggtacccaccaggtcctgaagaatcggacaccttaatcttggaccatggagcagcagaagtgagagacagtatgtctgagatttaaactaccctgtgtgcatacttattgacagaacccttacaaatgaacataccaagcttgcaagaagaaatccacatctattggtatcagaagatctgtatgatccaggccctgaactgtttggaaatgacaaggctgcttagctatgtgggaaagtgctctctgagctaccaggactctaggcagcttctgtaggcagagcacacaatttgtggccttcctgaaggctgcagaccttccttcctatgtttttctctgagcagctccttcccaacttccttagatggggtcacgaggatgtggcattgagggtgcccaagacagacaggaatatgagtgtcaagcccagcaggcatcaggaccacccttttgcagagccttcctcagtagcctatcctgctcaacttaaggcccggaaaaggcactggataatgaaatctgtgactttgtttttgagaagatacccagattgagcagagggtgcctttcaaagtcaagcacaatgtgatgagtctttagcactgtaaacctctgccttgaatgccttatctgacagcaccccccagtctggagttgtggttctcttttatctttattttcttgtgtgtgtgtgtgtgtgtgtgtgtgtgtgtgtgtgtgtgtgtgtgtgtgtgactgtgtatgagggtatacttgtctttagggatgcttgcatgagtgtgtgcagtgtatatgaatgtgaggatcagaagttcacatcagtcagttgacttccccatttgctttatttgctgaggtgggctctcttgctgaacccataggtcactggtttggctggtctagagccagcctgctccaaggattccttgtctctgcttgtcaagggctgggattataggctgccactcctgtgaggcgtttatatagatgttggggatctgcacactggtccccatgcttagacagcgtgcaccttaccctctgagccatctccctagcctgtgcttgtcattttggaacgttagctgctctagttgatgtctgcactcttagatggccaggctcctctgtgagtaggagaggagcatttgcttgggggctgtcttcctccaccatctgcagcagaactgtgccaggtgtttactggcactgcccagagaaggtatcacaggctttgggatacacaggagctccctggcgtgtaataggttagcaggaaaatgttaaattaaatggcctaatcacatcggagtttgctgatccctgcaatgaatgttcccagtggtgctggtcttttccttggccaagatcgtaagccactggggtcaggcatgactctcttccctcagctcttggcctctctgctctgggttgggcacactccccttccagcacacctatgttgattgattggtatggtgttaaacttttggctttttgtaggcaactgtaggagggtgttgagctttacaaatctgcccagtgcctaaaattgaactacacatgtaactcactcacatgcatggctcagttggactttcctccccccttcgtgctgcctccagctcacgtcccatgcctatcaggctgggctgctccttcatactatggtgctgccttggctggctggaaccggatttctgacctttgggccttggatctctgtggtactttgttgtcatactgaatggcagtgatgcctttctaagtgtcctgccacattgcttctgtattttaagaatgagacctgcttcttttgagaagtgtagagagagatgatgggccaagggtttcctggaaggggctggaggtctttagcccacagtcagtctctgtagtcagccagccttgccagaaacagttgttaagtatgtttaaaggacccagctcagtgccaggagcagcggggaatctgaagagctgatgagtttgcaaagacaagcagcagagaatttgggttaataaactcagacttgtgtcccaactgtttggttcaagtttccactgtctagcattgaccttaggtgaacgattttgcttctctaagcttgattgctctgtaaatttctacaaggactttcgagcatcaaataagataatgcatgtgggatgcttcagtatcttgcctgctacattgtaggtgaccaattagtcgttctcaaaacacaccggtgcctcacctttactgctgtgtgccaggtgctggcaaagaggttttgtcagggtttgtgtatccactctgtgtgggagcccagaaaaagacaaaggacaaattggctgtgagaaacttacctgaggtggagaactgggttttaacccaggcaatccttctctgaatttgtgactttagtggccttgctacctggtcttgcatagagaccagcctgcaaggaagctccatatagaatggcccagtttcctcattcttaaattccctgggggaattcattgagttttgtaaaggattttaagtgatgcctggcctgtgttaagcactcagtatctggcaggagtttctatagaactagcttcacacagctaaaagttaaggcaggtcagtggtggttgctatgctccattaatcccagcatttgggaggcagaggcaggtgggtctctgagtttgaggccagcctggtctacatggagagttccaggacagccagggccacatggagaacccctgtcttgaaaaacaaaacacttaaataataaaagctatcagatgacccagactattaaagcagacattttattttattgtacatgacaattcttcatccttcaggacacaatgtggtgtttaatacacataaggtctttatgctgatcagatggaggtgattagcatacacatcatcttaaacatcggccacttcctcattgaggggcattcaacagcccatagcttagatatctggaacagttcattgctgctctctgcagttaccatattggacaataggatgccatagcattggctaacaggcacagatgttttatgaggggagtggagctcagtgggaactgagttctgagaggtgggaagacggccgggcattctctgtgaagggtttcttatatgagagaaaatggagagccaaaggctggtgttctaggagcagagtctgagtagaggccaggagggattgttgtatggattttgacctatgagcaggtcctgagagttgtcattagcaacctgactgtcatggatcagagctgtttcggcagcccatcgctgcagagcagagcaggagccaccaggatgacagaggtggtgagccacgtgaggtggttgctttttccctccatctaaatggggcttgggattattctgaggtactagcccttggcccctggaagaatccagagctatgggttaactgcctttcagctgctgtttatgtcataaatgcctgtcacacgaggggccttaaaaataacccggtggctaatagcatttctcaaaataactgcttgagaagtgctttgctgggctgtgtggctactaaaattacactctctaccagtggggatggtgttagtatgtgtatgtatgggttgtaatcctgtatttccagggtgagtcccactctttattgtcttttgtcctgtggtccctcttgtcatggttctgtgtccaggaatgatgccttctatgtcactgtgcagttcccttctctgccccatggctcttggcatattggagaaactctcctacatggccttgttgtcctgcctcaaggagcagagttttgaagaatcttggagggcggggtggccttattgtggtgctggcctgattccttggcgtgccaggtaataatagcacaccgtggggggcagatctcactgtgctatccaagggggaaactgggccacagaacagcgcggcagccccactcaaggtgacctagtaagtgaaggtgtgaacacttgcattgtcagagaggagctccaggagctcttcagggggggtctcccaggccaatcctttgggtcacccagcaaccaggttactcaagctccctccctacttgcaattatatccaaggggatgtggaaccctacaagctagcccacaaagccgaggagcagtattattaagagtttggggtgaagggctgaggtcacttgagggtggtagccagtttttctgcaatcattgcttacatccagaggggtgagtttccaaggggagtacttactgcaactgacatttcatcgtatgggtccctgctgtggccttggctctctagcaggtgctggagttacaaagaggttcagggtaatacctagtcagggaacatttataagttagtgtgttgtctggacacctagcttaggatgctgtgaaaatgatctgcattcagcaatcactgtacttcaaagttttatcttttcccaatgagtgatatatggcatgaatctgccccatggtgccaggcagcagccatgagccatagctcttggtgtggccctgaggcgactcaatcatctgtactgtgattatctcaatgtccagtaactgatttaagtccagcactctccagacccagtgcgcttttatctatattaatagtgtgtgtccactctgggcttagattcgtgtgcggtgttccctgcacattagatagccagcagttactagaaaactggctacattttagatgattctgcccaagcgtgagtggatgtgtgtgttctgggtagctgaaatctggctatgataagccccactgcttggcagcttatatatattatgtggcatttttgcatataatattttttatcttctgatggctttactgagccatggccctgtcataaataaaggatgtctgtgtgtagcatccttatgacaagtggggttcttggtatggtaaaggtgccttcaaaatgtttgctggaccactgtccactggattcgtatagttctggagaataaagcccacccctgagattttccccagaatgggaaagcaggaagctcccagatcctgctccccccacccccaaagctgtacatacagagcacactgctgtggaaagagtctagtttctaaaattaggctcactcggtgactttagacaaagtttttaacctctctgaaccttttcttcaactgttaaatataatttggcatagcatcaacctcttagagctgttgggaggattaaatgaccctcattagccaggcacaggcatagctgtggcagcaccctgaagatagctgccagcattgtcttcacattaattgtgagcccgcagaagctggctttgaagcgtatgtcattgcttctcatcagggtgttggtaatttcatgtttgaatattgtcaagcagcggctgggtgaggctctcgaagaattggggctatttactggggcatgggctggccagctctggaatgctgactgaggaggaggtgaatcaggtaggggtacaatttgtgacagattgtcatgtaatcagaccttggtaattcacatcttatatcaggctcgttgtgagagttcaagaattaagaggaatctttcccacagatctgtatatacacgccaggatatacacctactccatgcaagggttcctaagtaggtgtaatggtcacatggtgtatttggcacagttgagtggagtactgctcgaatccaatgggtgagaaactagggacagtgttgttcactgtcccatcatgttgagacagctggcactgtaaaggaccccctggaccaaatggcagcagtgttgagatagaccctctatctaaatccaaagatggagaatagatccctaagggaagaggatggcttgctaggatgaggaccatctctgagtcagggctgggacacaaagataaagctaaatacccgagtttaggacttcttatatttctggaagcccctgccccattatggaaaaagaaaaccaactttccttacatccacgaagttttactctaggtcactgtccaggccttttctcttgtgccttcccaagatctattctgagaaggacagttcttgctgttcctggcttgctaatagaatgcagtttgcagaacaaggagataaaagagaagatgggtctgtcttatttctgtttcacataagtaagatgtttctcttctttgttgtcgttgcttctgttgaagtgatggatggtagccctgagaggtgagtagttagccaagctctgggttggcaggttcctaggggagaagctggcccaccatccatggtgggccaaatggtctgtaagttgagagggtggtgagtagtccctttttataactggaggatagttcaagtgaagtgtcagcaagtgacctgtgtccctggaacactagagcagatggaagtcatggcaactctgttgctcaactaggagcagagtgacctctcttgctgacttccaggccataggggccgagaaccacctggttacaacaccttccaggacagggctgctgtcgccatgtggctcttgaggttgcagcttgctacaggggacagagctggacagccagcagcagctggtccagaaggagaggacagtgcagggtgatgctccctcagtgctcaagacagctcctgctggccaatggaatccttgcatttcctgcttggtcttctatgtgccttgcttcctcagcagtccagacaatgggctataaagtgggcagtcaggaaggacctagcagtttctgggcaggcccctctcctgagcccgctcaactgtgcagacagcaagatagttcctggaggagctcatatctgtagccactcctgaagaacaacttgctgtgtaaagtctcagcctggtagcgcacttacttctgttggctcagacttgctttaagaggggatttggaccaaatgcttctcaacattctgatgcacacaagatggcttcttggaggattcatcatgctacctgccatcttgtgactatccatatgatgtccagtgtctgactgtcattgacctttatggagtagatgtccaaacgtgagggaatgagtacctgcagaagtcaagcattttaaagaaagtgtctgacagtacaggacgacatcattggcttttaggtctaagtagtcacctacactgataggaggccctgttcaaacactcagaatcaccctgtgtgtgattatcaggactctctaaaccatagatctgggataggaatggagatctgagcatttctatttaatttgcatatacagctactgccccaggaccatggtttgagaatgaatgccttgagttattgctcttttccaaatgtcttatacttcaggttgatggatttaaaaaaaaaaatcacaggatatgtggtgtgtctcttgtactgaattgtgatgccaaattgacagcactggccccaacagtgagggaactgcacactgaaaaaggttggggagtctggcggtacacacttgtaatctcagcatttgtgagataaactcatcacaccaggcattcaaggctagccttggctatatgatttgaggtcagcctgggctacatgagagcctatttcaaaacatgaaaaactaaaaacaaaacaaaacccctcaaaatcccaaacccccaaattctgacccaatctaattgcttttactagggctttttattaaagatgtaacacaaaatggaaatataaggaggagttcagtggagcggaatccattgatggacagtgagatgtccctatatctatccccatctttgtttcccatgtgacttgtctctccaggtgacctatgagactgaagtgaatgcttaatggtgggaattcagccctttaattctactacatttttctaattctagcactgacctgcaaggagggaaccctccccgatcctaccgacaatgtgctacctgaggtttggggtaatattttacacacagggcttcttgagaccagcatctttgctcttaggaggctcttttccaagagtcttaagtcatcctgagctaatgtttagctgggggcttgggcttgtcaccatctgagaggatagttcctaaggcagaattttgtctttggtacttggaggctggggagccaggagaatctccctatgacttgagtgcagtactgagttctagttgaaagctgaatgcagttctttctttctttctttctttctttctttctttctttctttctttctttctttctttctttctttctttcttccttccttccttcctctctctctctctctccctccctccttgccttgccttgcctcccctcccctcccctcccctcctctttctttctttctttctttctttctttctttctttctttctttctttctttccttctttctttcttcctttcttttatctgaacagagctgggggaagctctcaggcttggcctggcttgaagcttggctttccctcactctctcctcccatacatccttggcttgctttgggagtgacaggtcggagcagtccccagtctgtgatactggttttaaaggctcactagtgtgaaagtgctaggtgtaaagcacaggccctttaaaaccctccaggtgcgtgaacagatggaagagggcaagagaggctatgaacagtggggctttgcggagcgcattctctaaggcaagctgtcaaagtgtttgtgtgaagggcttcctttccagaaaactttgcaagtcaggtgggcttggttctattttaaagacaagaacactgaggctgtgggatttgagaagggcagcaagaggttggatctgatagaaggttctattctgctgtcgttgatggaggcaggaggtagagggagttgcaggtgatctggaagcaatgttgtggtacattcatgcttattctgtctcctgcatcccagcttcctttagaccatctatcccaatcagttcagcctgccttatgtcctctttccagcatctgtttttatctgatgttgacatttgatgtactgaataccttatttttattgttatatcacttctatcttggtaggattacatcaccctttagaacagtggcctcagccttcctccagctttctttgaacaccttacagcagaggtcagggtcagagtggagctgataaacactccatcaccttgctgggtagatgttccacacttgacatcaccaattgctccagttggctggagctctggactgctaaggttttagcatccaaagcctggcatattggaagacccctcaaccctggctaatctaagccatatggtcactgtacctcatctggcagccaaggatgctagtgtcctgggcacattgtattacctgaatgttatctattattactggagaagatcccagagactacttttcagtctctgactcagtgctcctccatgccctctgaaggagaaaggactccatctcctcccgtctgcctttagatgacaggtttttggaggtaggtgtcatctttcaggacacctttatgtttctcatcttctttggtgaaatgattctatgataagcaaaagttggctcaaaatctgtaaatgcaatcattggctttgaactcacagcagaggtcaagaccagggtggggctgataaatgttcagtcactggacattgccaggtatatgacccacacttatagctaccagttgttccacttgcatctaaagtctggcatcccaagggagccttagattggcatcgtctttcctccaggggcttaactaacaaggaagaaattgctttgcctcaaccaaaactgagatgttggtccctaggggcaaggggcagttcacaggctgtcacagccagtccttagaaatagcagcgctgaattcttgtctagcagtctccaaaatggggtggacaaggctgcctttcagaatgtagaaaggaaatatcagactatcaattcagatttccctgttcttcccttgtggacttctgtgatggtccaggtcttcttgcccagaaaataggagtgataccacccactgatgaggatcagacagcatagcacctttaaagcgtcctgtacttgaaaaatagcagtcaaatatgagaaaatattagagtcatttaaaagtggtttctgccatgttttctctagaaaatacaccctctgtgtagaagtcacaggaggctggacctacaggctgggactctttgggcttttctgtcctgtgagtcacagtcttccctccctgtggcatgtctgtccctgctgtctctggtcatcttcgggcagatcctggcttagcttgtacttccccagtagtcccacgttagtcccttatgaaaatgttacataccattcaagaaaagcccttttggtttccaggatggcaacaccgtctctttctgtcctttagccattatgataattgcttaggctgtagtgccaagacagcaaataaattgcctgctctctctgacatcccagtgctgtttttacatcatgaattgtcccagtgcggagataatccttgcttgtaatttcaccagcttcttaagtgaggaaaatggacaaacagctttctgttctccacacaccactcccaggttttccatagcgggatccatctctagtaagaggtccagacttgccagtcctggctgctagaaggttgctatcaggttgctgtctagattttgagtctggagggcccaagaggtgagtacaatgcctagacagggtggggagatgggggcaagagagtcacaacccccagcttttcttgaggatgggagcatgtgacttacacacaactgcttccacaaacctgccttacacacccctgcccccataacacacctgcctccacaacacacctatctccacagcacacctaccttcacaaactctgtgctaatgaagtgggtgtttctgctaccactatatctctctattaagctactgatgaataagaatggggagaaatgagttgaggtctgcggagacgtttctatacattgctagaaagctacggagacattcatttcctggaagagttggagggaacagggaaaggagggttggggcagagagattcctcttaaactgttccatttccaggtgattaaaaagacattaaagctgaaatgcatgctgactgctggcgtgagagtttcctctatagctccttctacacccaaactgtctgggtggatgttgatcagattcttagataccagctgtaccatggtagacagagtaggaaggagagagagggatgggggatagagggagagaggggaagagaggggggatatactggcttatcatggtagacagaataggaaatgggagatggagggtaggagggaaagaaagacagaggcaggcaggtatacagacatacaaacatacacatgcacatgggagtaggtcatacatgtcaatcgttgaatttgggggtggaagagacagaaattcttataatttaacttggaggctaatgaaagggctggagattctgcagtggagaatcatggctgggtgggactcatggcctccaagttattcttggttgacttccaggcctcaaaagaaactcatgatatgcaagaaagatgacctttggtggctgggaggtatgctattggaagggtatgggaagagcttgagagtggtcccagaagggcaggtagtccttccccctgtatttgtgttttatagcatattcttgtggccaggtggctgagaagagacaagagaagagaaggctgtgttcttctgaagaaggggtgcttgtggggcttggctcccgccatgctcggtgacaacctcagcttgctgtccccaaatcgtaccttctctcatgccttccattaggaatgtaagagacatccactgtaaactttagcctggtatcccagcagcagtgtctcaccccagggaagaggcagcatgctgcagagcctcctcgtgcctgcacttctggattccttggccagctgctcttctttcccagggagggtagcagcctccccgagagatctcttcttcattcactagagccataaaaaattaaactgcggggttatcaaatattaaatctgtctgatgaatgactacttgcagattcttatgaattctttgctttgattaaataaaagtgaagaatgagaaccatctaaccagcagtttagcaaaagacaactcaggcagtccttctgcctggccccagcttctgcgtcctgtagagttactaggctcacagttcgcttccgaggctcttgatactttgagttttgtacttttctggaattatgattaaacaaggcagccctccgaccgatagtcccttagtggttttgaaaactctgtctcagtagctcccaactccactgttctcagcctcgggtaagcccctgatctttattctcaaacctatgaaatagaaggaataaggaagatgccagctcatctgtatgattagtgcatgcaaaagacaccaaatgactggcatctggcagcaagaaggtcttaagcaattgctaatgttattgttgacttatttccaaagaattgtggttgagttgagcttcactttggtctttcctgacccaatgacaaatgacaagtgccttaatttgtttattaatccaaggctcttaggtcccatctttagtgggacataagaagtacaacaggtcaccccttacacataaggaaaatgtgctcttagcagaagagcactgtatatttgcatacatgtgtattatgggctcatcatacaaatgcaaaaaagtggagaactgtgggcagacagggtcatcagggaagctaggagatgaaacctttacagggtgggtggtggtctaggagaggggaccttcacagggtgggtggtggtctagagcctctaagaaatctgcagcagccccagaaaaacttagcccacattgttgtttgtactctatttcccatatgtagcatggggcatgctcagacctaaagaatgtcatcatgaagaccatgtgctctccccatagctgtttctgtcgaattgtttgttcctagagagtggactgtctcctttatcgcacagtgcttcagtcgcctcataaaaaacacaagcccctcctggccgccttgggctcagctggagttatgtggctctgctggacctcctggaggtcctgcatgtagcatgttcatataagaggtctgtgacttgcttttacctgtaggagccttggttcactgtgccagaccgtcaactgcagattagcaactgggataggatccctgcagccagatgggagttgatgtggtcaggctcttcctgtctcggacctgtagccaggtccagtgggaagtaagatatacttcctgatttctcaatgccctcttgtttattagtcagtggcttatcataaagggggacaatgctaacagcacaggggacacacattagtgtcttagctggcaaggtcagtgggtccttgcagcttctgtgttaattttcaggccaagatgctcataagaccattgttctctttaccctgctttatcagataatcaatgagcaagtgtccccaagacctgagctggcaggcatttaagaaatctctaggtggctctgtgggaaacctgaggaattctaagacatgggcactccagtcgaaggaagcaagagagagagagaggtagacgtaaaaggttaaccatgtcctagcatggaatacaagacccctggggaacaagtcagatagcaacagctcagcagaggggcatggagtggcttttgtccatggcaaagatccagaacaaagagtgactagctgagggccacaggccatggagcaccttatggatggggggtgggggtggggcaaatttgacaccttcactacttgtcttgacctcgaatagtcttagtttctagttgtctcaaacaggcccagcggtgtccacctcagggatgacaaggatttaatggcataatatgcacatacagaggtcagactgaattgcctgacagggacatgaccgtagtttatcactgttgtctgctgggttcaaatagtctttcagggggctcttgaggtacagactgagccatgtcccgcctcactcactttgctgacccattttatgtcaacttgacacaaaccagaatccttttggaaaagggaaccccagttgagaaaatgaccgcgtcagattggcctataaaccagtctgtggtgtcttgtcatgactgataattgagctggggagggcccaggccattatgcatggtggtgtccttgggcttgggtgctataagaaagcaggctgcataggccataagggaacaagtcagaatgcagccctctgtagcctctgcctcagttcctgcctccaggttccaacctttcttctgtcatagactgtgatgtggaactttcctccccaagtcgcctatcatgtgtttttatcacagatatagatactctaagatactaagatgctgggtaaggtaagggtgaggctttacgaagaggaagattggctggcccctgatccttccctaagtgcattttattacagacctgctatttacctagtactgggctggtccttggcaccggagaccctttgcctgtgttcatgcttcacatctctgtgaccagctgaatgacactcagagaggcaagtgatctgtctctttatgaacattaacaaggatggccgatgtccattcacattcttttctgtttgctgtgtgactgtcccattatttccaaaggtcccgtgtgcacactgggaaccacgcccagtcaacaggaatgcaaagaagcagaaataaataatccttcccgttcatagcagaaacatctaccgttttttatgctttgctttatttttctctccacattgttactgtgtcattttctttgtaatgttgagatcctagagtgcatacagtgtggtgttctgctgtttctattgacgtcctctggtaagcagttccccctgtcactgggactctattttgaaatgctaatatagttataggtactcatcccttttctttatcattgccttttagtggtttgtatttttttgggggggagagggagctattatgagtattaatgcactatctttttccagagttatacacatcaccccatttgctcattgcaatcctgagtgtattcagtgtgtatggaaatgtgctttttaactctaaggaaaatacttgttgatattcagccttggcattgagacatgggatgtaaaaccatctgacatagcaaaaaggagcaaaaaggtacataggtgagatttaacatgcccagttttgcgatgctgttgtctccgttaaacatccctggctcatagtaagaagatgggcaggtgcatctggtctccatctgcatttaaacttgcgaggttttgtagctgacccccacccctcgtctgtcgttccaaccacaagccgtaggatcacttacttaaggatccctctgctctcgtgactcacccaggctgttggtttgcagtcttccgggggcacagaggaggtttcgcatggacttggacacagtctgctccctctcctctcagtcaggatcagagtgttcatttactcggctctccttctctggggttcactacagcctgggcctgctgacaactggtatggacaccttgtagttttataaaacaatgagcagagcaattaaggagagacagattcttcactgaatcctgatttgccaagtgagacttaacatttttttttctgagacagggtttctctgtatagccctgactgtcctggaacttactttgtagaccaggctgtccttgaactcagaaatccgcccgcctctgcctcctgagtgctgggattaaaggcgtgcgctttttaaaatacagttactacttggacgaataaaggaactcttcttatattatgctttaattaagttcagagaacatattgtcctgagcagatataaaggcaggaagtagagaagacttgttaaaaatgtcataggatttacggttgcagggcatttgctatgtgaaggaacatacttagctcggtagttctgtataatagtgtgcagcaactgtgagccttggatgatggacccagactttcatattgttgttcacagatcataaacagcatgcttgagaccacctgacacacatcaacagggactgagggacagctcattttcccaaaaatagcactttcttgctaggggtatgtcgggctttcctgcgtgaaacaacttaattgtagtgttttaaacagaaggggtatgggtcatgggattggtaaatatatctcactcttatcaccaagggggtttaagatgagtgtgggaatgtcacctgcctaggtcacaaatgaccaagggtcattctaccattccttgctcataacagagatccttcattcatctctccttctgactgagccaggatgtgagccctatatttattcttttttaacacattgctttagcagtacttatcatacatcagagtccatttgcttgccattgtaggcacaggagatgttattttggctatgtatcatggtgtggggaaaaacaggttactttctagaagattctttggcaagcataagcatgataaactgcctttcctacatgcttgtccaaagagctggatgccattaaagtaaggttcacctgtataaagaacacaggtgcccttccagcttgcagccaacaaagtgtccactgggtcatgcgatgatgatgtattatgtcatctgtccttcacagaaagcctgttatgtttgattgaatgttttctattgtgccatttatgggatctacagtgttgggatggtctcagtagaggctgagtcaagatatgtgatgatgcagaggctgagaatggtctctgcgatgggtcatagatgtcaaggtcagacacgttggcctgtaggacacctgccatacagcacaaagctcttcttgagacggtaaaggatctgctaactttgatcccctgtgagttactagagggtgggtctgtggcttagttgattctgtatctttgactatttcaatctctaacagctaagaaattcttgaaaaggtatcagtggcccacaggtcaggagaagattcatccatcgggcttcaggcactagagcaacagctaataatatcattagtccactagagatggtttcttccccccaaaaagggccattataagtctttataaccttacagacatcctaggagagcagacatgattacctctacctagcttctcgtctggatttagagctgcctgggtcctgagtaatgggatctctgtgcagaaggcctttgtctgggtagcaagaagaagaaacttggagagcagagactcccatactgggccaacatagggcagggtcacaggacagagacaagcactagcaggaaggaatggggcttacaaagtggggatgaattgcatttcggcctgcaaggaggatggggaggctgaacaggcatggctccctgtcccctttctgagtctatctttgttttctggcttacaatgcattgcctttgggagtggccttttgacatgtgctaattatacattgtcctttggttcatttgagagttctaataattagaatttctaattccagccttttgagcgactcccagcagtctcatcctgtgagggtagcagtaagttcactggatttcttgtccagagcaggaggcccgtttcctgtgcacaatgggaagctccgggttcaggagtgcgagtggaggtctctccttgcagcccagcccagctctgccaggagacctggatctcagggctttatattttgtaaatgaggaagctcctcaactcaaaactacaaatcagagtaatctgggaatagaaaacatcctggccctagcctgccaaaggcttgctgtggcccccgagcaagtgacattttgggcctcagtttcctggctaaatactggggtcatcagatctgtgactgccaagagcggtttcaatttggagattatttcaacccaccaaatgttcaagtggtgtgttctgggtcattgtgttgtgattctgccaattctcactacacgactttccttttcaaattatttggtaacactatattaaacatctttgttctaggtcaaggtaagattcacagggtcattttttcccccttacccaactacattattttgcctagcttccctcacccttagcttcttcatctacaaaatgggcattgggactccttagtggtagtgttgttgaacatcccatgtaaaatatacagtattaagcttacgtagtgacgagcctctgtagagcactgtagacttccctggtaccatcagaaggggttcattgcagtgtcgtcactccctcccttgggatgccccaatgctgcagtatctctcagagtgtagcagtttagcagtcagatctgtgatggacctatgaggaccctgccaactccaccttcatctgaaggcttatcctgcttgttggggacactgccagatgtggtgtcagtcctgaaaagctgctagacacccacccttccttcttgtctactcataatggctaaggttgcttgactgttacataactctgacatttctgtgagtccgtttacacatgtgctttagggacatgaccaggcacggggtagtgtgaataggaactgatgctactagattttagaaactgtcatgacctatcacaatgacctatcagtgtcccaccctctgccacagggtgtctcccatcctggttcaggtgtcacagctgtcccttgctgagtcttcaaagtctcagaactagaagtgtggaagatttgtgacagagggactcttgcagaggtcatttagttcaggttccagctaactggtgaggtaatgagggccgagatgaccgccaactgtgtaagcccaccagctctcctaactggggtgcaatgacctttctcctctatgcctcccccccccacctcagaccttcttttccctgaaatcacctcagagagtcacacaaattaaggtacagcctttgaaagagagaaagggagaggttaaaacctcctgatgagacatgcacctgccccgtgtgagtttgcaaggatcgccttaacaaacgccaccagtgtgcatgacctttgtcatggaggctggaagggcaagatccaggtccaggcagagttggtgttttgtgaggtctctctccttggcttgcaggtgactgtcctctctgtcttcacctaatctttcccctatgtgtgggaaagacttcttataatgatactggttgtgtaggattaagacacacccggtggcgtcctttgaatcaatcatttttctaagggccctgccttcaaatgcagacctgttctggggtcctgggtggaaacacagccgagatcatcatatactctcacactactggatctgatgctcatggtcttgcttcacctatgacaatggaaattgtaaccctatccacttatggagttcctggtgagtgatcaggagagattgtgagataccagaataaaatgaaaatcacagggccattagagggtgaagatgaagctcgtgaggcccatcttcatctgtgtgactgttccaaggaccagcactgctgaggtcagaaaggagacacagcctgtttagtcaagaccaagaagagagctggcggtccttctagtgagtatagctgattaagataattatattagctggccctcaaagacacatatttatagccatggcgattcgttattaaggagctaatttagatcagagatatggaaatcttatttttagacccaaaggggagcccagcaggcaggtgactggaggtctccagtggctttcttattctttctgttgaaccagagtctctcaaggttggaaaaaatttgaaaggtcatgctaagccaccatctagtgcttatccccagtgtcccactgaggggtcacccagctctcctttctactctggcatcctatcttagaagtcaggttctactgaaaagcaaatcactgtcactttctggaccctcagcaagatagaggtcagatctaactgctcgaaactcttctgaccttgaggtcagagccactggcccccttggcctttacagtctagccaagaggccttccagtttaggagggaattgcaggagtgcccggcctcctgtgtttttattgatatgagtgtcccattctgggtccagcaagcccactggtggttgttctactgacagctgttgctccatgtaggagtggaacttggttgtttgaagtcgacagtcttctatgagagcctttttggggaaacagtttgtttatatttgaaaggaaatcaaccaaacagtcactgactggggagagagggtgaaaaagaacccaaaaaccatggctgggtacttatggacaggtgttcctttccttcctccctgctgtgagcagcggcacttcacttacctggtgaccccagtcaggccacagcgaggcgaggagataagctggatactctggtgtatgcttcgctgggaaatgagtttactttgagaagcttgctttgctcagcccaagcgtgagaagtttctacacagagcccatgttggtcttgcactgcatcctgagcaaagatgaatcccatagatctcagtggacacggcatctaggccaccgtgaatgggagtgctcttggaccattgtgagagcctgagcaagtcttcatggtgtggtcccccaggttctactctcctcccctgctgtcctgagggggaacctagatgagacctgtggccaactcgagattctagagtgagtagccagttcatagtgaaccactgggaagctgactttgtctggatagttgtgtctgtctcagtatcaaacaacagtagaacaaaaggagatagggtaggttttagatgtgggggaattggagtctagaacgtgtttcctaggatacgttctagacaagtgttaactaaagtctcctaaagacaagagaacagaattgtgtgtgtgtgtgagtgtatgtgagtgtgtgtaactgtgtgtgtgtgtatgtgagcgtgtatggtattggcgtgtatggtatatgtatttttttatatgtagggtttctagggtttctaagtgtgtgtgtgtgtgtgtgtgtgtgtgtgtgtgtgtgtgtgagagagagagagagagagacagagacagagagacagagagagacagagagagagacagagagagagatgtgggtaaaggaggcatagtatgtgtgtggagcttatatgtgtgtaacatacacatgtagggtagagatgaaggttgtttagttatgtgtgctgtgtagtatgtagtatatgcctgtagccaagccaggggtgtgcctctgtgcaggcaagccctcttgtcacctcatccaacacagtggtgttccctcctcttgcagctggcatagccatgattagattattttgagaaacaaagtaggagaatccaagtttaaggacaaagcaagtatctaaaaatcatgtctcctgggaaatagcttttggtggcaattccagagagacctggccacttcaaataagatgagagtttcccaagttagacaccagcgaggtggtgggtcccatggacaggcttttgaacacgattaaatgccttgttcagtatgatcaggattagtgtggagaggtttctttttactctctaaccctgcttgcagctaaaataagacttgggaactagtgtttcttttctattcacagaggaccctgtgagagccggcaaagtgccgaggagcatcatggtacagccagaagtgacacagactctctttctcagtaatttggcgcttgggacatggtggtagccttcgatgcacattcctgtgtgccatctcttctaggacttgtgtttctttcaacggaagcttcgccatgggtggcgttgccacatctttcctttgacgtgccttgtgaacaacctcaatggctgttctgccatcacttccccagtttattcaatcagaattgctgctgaatcctgagtagcatgagtcctaggttcctttgtcttcagaaggtgtggcctggtatgagctatccacagccatccatggggcaaacacaaacacatttccattgctgtagcccttaccatattggctatttttatctgcttttctttcctgcctctctctagctgggggccagtgaagatctgcctgtgccccaattctgcttccctccaaaagatactcagagagctgggagccaggtgccaggagtgcgaggaatccccaaccgctgcctttgtgcttagcatggctggtgagccaacagacttttggcagcatcttggatctttgctattagctgattaaaattaaaaaaggatgctgtgctgttccttgccatagatacagacagtaaagagcccttagctacttcctggcttctgtggccaatttttggcatcaaatccattgtgaattgtcattcttctcccacccccatgatcaggaaagtgcattaacaaattaaaattctctcctgagtcagagtggctttggtttctgggtnnnnnnnnnnnnnnnnnnnnnnnnnnnnnnnnnnnnntcctacttgctgagcagcaaatactggggtttcagtttagccaacatctgtgtttgagagtgatgtgtccagatcccattgccttctgaaggtctttgtgcccctccatttacaggcctgttcccagctgttctttgggcagatgttcctcagttcacacggccctgggactttcccatgacctctactaagttcattttggtccctaaggagtcccctctgtcaactttcatagtcagtactttgttcagacacaggtatgatgctgtcactactaggctgccttgtcctagagtgaccagggagccacccaagtggatatcagcttacacatctcacaggaactcatagggaaggcttcctttcccaagcttctatgggaggcttctaatttccatggattggaagacatgaacagtccaggtccttcagttgcctctggagacatctgatgttgctaacctgatgacatgcggcaatggcagtgatggtgggggtgggggagtgtgggaggggtggtctttattgggctttggaagacatcaggtatgaggcacaatgacatgtcctacagctaggagcagagtgagtacttgcaagacaggaagtcatattctttggttctgagaaatgtagggtgaaggggtagagaggggagggacttatgaaggagttggtgatgatcctgctcagtgctgtgctgtagtataatattatattagtggccttcgtgaatgaggacagcaagggaaactatgtgccaagactcgggcaggtgaagcctccttattagaaataagatcacagggaatgtgtattggtacctgctggttgaccttcacccagttttgtgaagagggtgccctatggggtggctggctactgtagaggtttggggtgctgctaggcctgtataacacagcactgtggatgaggcattacacggcataactgattttcttacactttccagttccacagcctggaagtccaagataaaggcgtcagtgttagcagagatgggtccttctgagggagcatttgctgcaggtctctcctggagaattctgggtcctgatttctctttctctaaggatatcagtgatgttggattagagcccaccctaccaagcacattctgacttactgacatctccatgaagttccagtctccgcagacagccacattctggcagatatggtgtgtatagaagcgtgtcttcctcatgaatttttggcactgatataacagcacagagaggataagcaatttgtcagatgtcacctaggattaggagtcagccaatctcactacaggcgcttctgactcttaaagggttaaaagaggaggaactgccaaagcagaccttcgcaaatggcaggaccatttctggtgttcacatgattaaataaatgagttctgtgaaaaaaacaaaaacaaaacctgagacaataggagtataatctttagaggatagtctccatttccagtctggctgacaatgtgatttgtgtctatcctggaggtccaggatgagcaccaataacagtagaaaacattatactcgatggtctggaccgtctattccccattccatgagcatatctctgtggcttcatttctaacctgatcggggcttatttcaaggtcagtgaggctctcgtggatgtagaacttggccagggcccttctgtgtctctgtgccacttagagcagcttttctgaagctcctgggctcccttacagtcttatttctgactactgatacatgacaagttgccttgaccttgtcaggcaacaaccaagaccatggagaggccttagtactttaagctgacttcccctctgggcaaatgaaagctctggtgcagaagatgagctttatggacccgagcagctctagatatccacatacctccactgcagcatcagagagtcctactcctgtgttgtaaggatgagggttaagtcaaactaaatgctaatgcctgggaccctgctgaattatcccctggtggctgtgacccccccctccacccaaagagaaactaattgtgttcaacctcacatccactgaactctgcgcagccaacctgattgtagatggtggctttggagacagccttaccatcatgtccaagtgcagttgatagggagggattggaatgtactcatttggtatgaagtctggccctgccaatgttgtggccacagtctatgaatgcagatgaaaactgacatgcacacactgagtaaaggcctctaggaagcatctggagtggatgatgcttttaaatgcatggctacatcagaccatgagccctggaggtggtggtgtatgtcaaatagagatggccctggctttataacatggtgctttgccctgtctcgactagcgctccccttgaggtctttgttcttccagatggaaccatcatgcatgttcactgagacccgagtattgtgtatggactcctcattttgtttcttcaaccttaagtagaatcatttatgcccttgggaaatgcatgttcaggtggtctgcggtagagcccaagaagctgtagtcttgattgagggtcttagaacttgaacctcacatattcttccatctgtatcccactttctccctcccgcttttaccctgctctatctttcaacagtacagctcagctggtttctggtgaagccccccagcccaatagtctgctgttgtgggctcatagctccctttccatggagagttgagtgcctgaattaactcttctggagcagtgaaccaccctgagtgctaacctagtttgtatttttagagtgtgctctatcaattacttaacttgcagagcgactcttctgtgctcactggggaagcactgccggagaatattcttcctcaggcttctgtaaggtgtacctttcctggtccctcctcttgggaagcaggtcagatggagtcttctctccatggtgttgtgttctcagtgttgaagatggagagtttgcctccttgcccctgaccctgttctgtacatttgaaagaaactggggcccaggatggtatggaaccaggtgatgtagcacggcagtgctatgcatcaagtttccgaaggcccgcacctctctgctgagttgggggagtcagtgaaattaagagtctcctctggccacataggattcactgttgggcaagatggtgctctgaagggaagctgggtgttaggagcatgacctgtgtcactctcagatagaagtgagggccaggcttgtggtttttatttgtggagaaatgcagtatgctgggccagggccatattagccggtagtttttgccatgctcttgccagcccaggagaccttttgactctagctccaggcaaatggccaaatgacttggtttgaatttcatcatggttctcccacttccggtagaggtgttagtgagcaaccctctgccaagagactgaggttcccaagctaggctgtgcaggagaaggccctcatgggaagggcccaggatacttgcttggaatcccagacatcttaactacatgctttccatagacctaaggccaaggaggtgacagccccgctgatttagttttgagtaccagatgagctcatgataccaactaggatgctgtgggtggtacaaggccttggagagtaagcaggatccagtttcttccttggggcccttatatttctttctagaaaagcatgatgtatctgtctgcaagggaaaagctaaaagcattaggcagtaattgagtgtgtgcgtatctgtatatgtgtgtatatgtatgaatagtatgcatgggtctctatgagtttgttacacacacacacacacacatatatgtatatatatatatatatgtatatgaacatatatgtatttacatgcttctgtgtgcatatgcatgtacatgtgcacatatttatgtttatatgatacatgtttgtgccctattatgcatgcatgtgcttatgtgttatgaacatgtgtatatgcatgtacttatgtgttagtgcatacatgtgcctgcctgtgtgcttgtgtaaatgtgtgtgcttgtgcttatatgagtttgtgtgcctagatgactgtgtgactgtgtgcatgtatgtgtgtgtgtgcacatttgtggttgcagctgcacatttgtcatacaactatgtaaaaacatgtatgtgcatgtctgtgagtctgggtcttatgaatctgtgagcaaagtactttggagtaggattgtgaagtgtgccctcagtggtgggactacatctccagcctacaggttctctggaattcacccaggagaacttgactataggtcagaataagacctcttgttccccctgggccatttctgtttcctcaggactcagtggacgggaaaagaggatgcacacagaatgcacacagactatactcagcttcattcagcacacaccaggaccttcacaatccacaacagatttgaaagtgacccaggcctatgctatgtagaaaatacgctttaaaagtgcttgacaattgcagaaaagctgaggcaggaggtcagtaaggagctaagctaagggtgggatatccctgggaatggacaaatagtgggcagggagctcccactgcccggtgatcagtgcctctctttccgagtgtggaagctttgtgatgcggaaagctacactgaattaaatatcaggattcctgctctagtcttgtttttgtccttgctgtgtgaccttgagatggtcacttgacttctcagaatctggctctcctgtctttacagtgaagacactgaataatctcttgacaacagcagccagattctctgatggaagacatcacttcacaaatagtggggcagggaagcatagagcgcgcatggtgctctggaatatggttgagaatgggtctggaaaggcttgaaggctaaccagagcaaggggcaaaggaagcaatgcagatatagcccaagaagcaggctagcacaatatactttattcttttaacaaacattcatgcaacactcagtggacaacaggcatcatgggaaggagttagcagactattggtcctcatgtcaaaggggacccccagtgcctgatctataaataaagttttattgaaacatgtatgtctgagttggttaacttttcatccctactagatgccagagaaaacagctcaaaagagaaaggttgccttggctcacagtgcgagaagttttagtcctggttaactggctacataattctggaccatggtggggcagattatcatggtggaagggcgtggaggagaaaagccaatcacttcctggcaaccaggagcaaagaagaatcccaagaagaggccagggctaagatatacctttcaaagggttctacttcccccgattgtgcgccacatcctaaatacttcctatgacttcccaaagtagcgccgtagctgggagataagttcaacacatgatctgtgaaggaacatttcatattaaagctataacaatgcccatttccctcctatctattgtctatggctattcgagactaccatagaaaaatcaagacattgtgactgatctcaaaaatagttacagtctggcctgtttaggaaaaaccgtgtcatctttgctgtaagatctttatgtacatgaactgaatataaaccacagcactactgggcaggtgctagttttctgtccatttacagacaagattttttttggggggggcagggtatcaggtaatgtacccaagaccacagttaagccacacaggaaaaaggagatgggactatgaactcaggctcccagactccagagagcctgtgaaggctatgggcaccgggttatgctgaacaagcccaggaatggaagccacgcatgagtgctggtcctcacaaggtgtccttgtcattgccaggtttgtgaccagggtggtggttctcaaaggcctgtttcagcagtaacatggctcaggctgcttaatggggatacttggtccctctgtgctagtgaagttccagacagttcttagaggcaacacagaaatgccattgctcccaaaggctttgcgcagctcctaatttagcgtttggatcagtgtttgtggttgccaaacagctatagttctgtgtcctgctgcagatcacaaatgcttagaagccctggttgtcctccctctctgtgcatcagagagcagagattctttatgttcagaaacatttcctgttgacaaggagcgatggaaatagtgctcccatagggactttgacacaagcggctatcatgtgccaaagtgctcataaccgaagcatccaccnnnnnnnnnnnnnnnnnnnnctgctgtgctgtccagtgtggtagatcccagctatatctgaaagtgggactagggtgagtgaggagctgaatttatcatttgggtgtttccttgagatagggtctcactatgtagccctggcttgagtggagcatacctatacctatacctatacctatacctatacctatacctatacctatacctatacctatacctatacctatacctatattgatctatctatctatctatctatctatctatctatctatctatctatctatctatctggtcagacagtgacttgcagagatagatagatgctctaagcagaccacatgggtctcaggtatggatagaactcaggttcccatgtttttgggaggcacctttatgctctgagatgtcttaacagatctgaggactggatatttttaaagtaatgtgttttatttggccttgtcccccagaggtccccagtgtggttgagtcttggtcatttgcagcgatgtcctgactgttaacacaccctgtatggattcctctgctttccattcccatttcctcttttcctttcttgcctaggaaagccatccaaataaactactcattcatatcatatgaaatctccattcctgaagcctaaaaatagctgaatgtcaatacttcataattcagtttataatgatattttcatcttatactcatctgagagagctcatccagatcagtactgaggcttgcagtttcccatgtgtgcaagccataggtgggcagttgcctgtgtgtgcaagccataggtgggcagtttcccatgtgtgcaagccataggtgggcagttgcctgtgtgtgcaagccataggtgggcagtttcccatgtgtgcaagccataggtgggcagttgcctgtgtgtgcaagccataggtgggcagtttcccatgtgtgcaagccataggtgggcagttgcctgtgtgtgcaagccataggtgggcagtttcccatgtgtgcaagccataggtgggcagttgcctgtgtgtgcaagccataggtgggcagtttcccatgtgtgcaagccataggtgggcagttgcctgtgtgtgcaagccataggtgggcagtttcccatgtgtgcaagccataggtgggcagttgcctgtgtgtgcaagccataggtgggtagttgcccatgtctgcaagccatagatgggtagttgcccatgtgtgccagccataggtgggtaattgagatctttccatgcaccgtctgagttctacctcagctctgtctctgtgtgaatttggcaaactgctaaaacctttctgcttcccagtcttcaggcatgagcatcctgcctgcaccccagcttggtgcttgccctgagtgctttaaagaatgatggggaggagcaagggaactcatagaggggactattaatgatagacaagccagatcactatagggggaccctgctctctaccagggtacaagaagtcccttgtatacttcaggaaatccagtgtatgtctttgatgtcacagggtctggctttcctgccacactttacctggagagagacagagtgtcctgttttcataatctggtctttttagcaggaggcacctggcagctagcatgagctctctagtaagaactgcagccaatttccccaggctgcagcttcatatgagggagagagttaggtctgtagctgctcagggacctcacacatattcctctcccttgtccacagagtcagctgacagctcattaagatggtgctcatggagcccttagagagctattcttttggtattgagtcagcaggggtgagggtggactgtgttctgctatgttcgttgcatcgatgtgaaggaataccagagagaagctgttataaggacagaaggatctgggctcacagtttcagaggtttgaatgccacttggtggggagtgaaggaacagggcagctcacacaaggggggccaggaagcagagaaaagagagcacaaaacaggaggaaaccaaggcaagaaactgtctccaagggcacacaccccagtgacctaccccagctaggtcccaccatctctcaatatgacatcacattattaatctatccattacaccagagccccgaggatctaattgtgaggggtacccacacaggtacagccagaggggttcttcactgattacctaggtgtctctcaatccagtctagctgacagtcaaggttaattgtcaaagggtcatgacacctgcaggcccctcccaacatcctgggcttcctaggggtttattagttatttgtcagtatacttgttcatgtgtacgtgtcatttgcaagtacttgtgtatccgtttgtgtagaggacttgggtcaacatcagagtcctcttcattctctttctgccttactttgtgagatagggtctctccctgatcctggagcttgccaattaggctagactggctgtagaggaagacgctgggatccccctgtctctacgggcagctttggctctggaaacagtcctgatctccagttttctttctcagtgagctctgtacttggatttgtaagggggtttgctaattgctaggagtacagtgctgatcaagatattatctgtccttgggggtcagggacagcattggaaagggaacgagacagcagccttgtgaacacgagctttctgatggtcccttgggccaagaagataagcaggatagattgacagcagagagtgacgtgggtagggctgcaaactcctttaaaaagggagagcctcagaagttgtgcatggaatgagaagataatgatgtttctttttcaggtcctgagagaaagcctgtcagtggggccagcagcccacacaaaggcctgggttaggtgggaatgaggaaaacaaaataaaacaaaacaaaacaaaaaaccagacagatgtagctgaaactgcctgagaactgcattgcaggcattgacagtctgacttcccttgttttggttcatgcaggtgtcttgccttggtgagtgagtgggtggcaaagacccttcccgtaagtcatgctccattcaactgtggcactaagcaggtggctgggagctggctttctgcctcctgaagccatatcggaattcctgcactgtttctaaggtgcccgggaagacagcagattgcttctgttcagtccatcagccacacaaaagccccagatcaaagagcatgggcttaatttattttgtttattttccagaggaaatagtgcttccttggactgaaagctccgaagactaaaagctgaatgagagggggagcttggattaaatgaatgggctggttctcgctgacccagtttctacccagtgccacagcagcgaagggggaggggtccattctgctcctctgctctggcccaggggcaggcacttcctagcctgttatttcacaggggatgagccttctgcacaatcaggcttcatggaaatgtccttgaagggagcttgtgatggtagcaggagggaattagtgtggcagcttgtgctgcctgatgcccccgtcacctcggctgggaggagaggtgccgatccaggtaaaaccccatggcttttgtaggaactcactaaatgggattgcaaaaggtgcctttccagtgggggaagtaggtgcacttaccacagaggcgagtttaatgttgccattatagtgagtaagagctggccgagattcttgcttcgaggagtcccaagttcaagtggtggcttcagctttcatttgccatgggacttgacactcttactcccactcacatagaggccccagttctcacctctgagccagggctaatggcatctgcctgtacctccttccaggatgctgtgatgccctgaaggtatgtgtggttgcctacaaagcaatgtccggatacccaaggaataatgttctgtttaaacaaaagatggcgtgatgaagcaaaggaaactgaagctggtgtgctactctcagtctccagggcagtggttcttaccccataggtcgtgactcctttgggagttgaacgaccttttcatgggggttgcccaagatatgcggtgtaaatatcagatatttacattatgattcacaacagtgctaaaattgcaatttcaaagtagcaacaaaaataatttcatggtcaccacaacaagaggtaatgtactaaagactcacagcgttaagaaggttgagaatcactggctttagactacatgggctgcagatgatcatgacagggataaggaaggagtataggcagacattcatagggtgtttgtgggggctgccacttcattggtctagacaattattttgggtgttcttgagaaggacagattgtgtttgatcctgtccacttgacatggatgattgagaaacggtcttgagatgcttgggcctacccatggggttcttgcttctctgcatcatcctgggtctaataagacctttaaaaagcaacatcatccaagagtgatgacaggctttgaccatggcagtttgagggttatcctctaattaaagaattaagtcactaatccacaggatgagaaagaacacctggggaggagacatttatatgtagtggtcactaataaactgattttgataggcagagctttaactttgaggactaaagtttttctaacgaagtagacaaaaagaggccttggaatgttaaaacacactcaactaagaccagtgaaaatggccaaggatgggtagtaacatttataaagttctaggcattgtgttggaagatgagtgagatgggtagcatctctcttgactagaacaacaacaacaacaaacagagacaatgtcttcatgggagctggagaagtgctttaaagtacatttgtagtgctagagaggctctgtgttgcagggacttgagccatattctaaaaggtatcatgggttagggagcatttatttatttaaatatttattgagtcagagtcttagctggtggtagcctagcctggcctgtaattcactcttgctcaaggtgacttcagattcacagatcatcctgtctcaaccttgagagcagaagcctttgcatatctttttcagtcactctcgtagagtctttctgattctttgagcgctagtggtttttggttggatgccagacattgagggttttaccaatttgggcgctgaatagttcagtcctcctataaatattcttgagcattttgtcctgggacactgcagttgggctgtgcggctgtgtgggaacagtttgatcctctggggtttgccctttttacagtttgattctctaggtttgtttgtttgtttgtttgtttgtttttaaggtggcaagagagcaccttcacctcagctccctttgcagactacagtagtgtgaggatttggcctggtaccttgggagtttggaggtttctattctggtgagggggaacatagactgtttaaagcccattgtgagctctggcatttactctactctgcctttggtagttgtgacacatgcctggggtgatgagatttagctgaaggctcgggtcctgctgtcaacttccggcctgttgcccaggccactctactttctggtgcacctccctgcaaaccctactctcttcaaccctcctggaatccctccaccctatcatctcagtagtgatgaagccaaagacctctttgactctttgtgctatggccttgatatctttcggtgagaaattggtgcaacctgctctgctcaggtccagggattgctggcttgctctgtttgaattccccagggtttaaaaccttgctctgattgtatttagtctgatgctttgcactgtatgatgtaggaagttgggtgtgtcccctgctgtttcctttgcagagtctttggcttataggagaagactttctagccttacatgtttgtgcctggttttgtctcagtgggtgtgagaatctgggctccgaaatagtcattcaaatgatcttaggccttaccttgaaaatactgtgattgaattgctaagctcagtacttgtggatcctgaagtaatggtcattggggtcagcctgacctcagggtacacacagtaaaggcaaaattgacatttactatggaatctagataaactggtgtgtgggtccataccatgacttcccttaaaatgtaacagtgagtgacttgatgtgtagcagggaggtgtccccaaggaccaactttgccctgggtgagcttttgccttcactattgttctttcacataggcatctgcattctgttctctggatgggattacagaaccttcccaaagataaggtctgagtcccacttttcaaaggatgttccggtgtccagcattttcatcagcatctcagttggcatagacctgacatcaaaagttaaataagaaccaggaaagcaaaatgaagggatgaaatacgtgaagggtagctctgtaagcatgaggatcttgcctcaatccctagaattcacataaaaaaatggcggttgcggtgatatacacttgtagacccagcctaagggaggctaaggcatggcggttcctggggctcagtggccaaccagcttgccttgcttgacaagtttcaggttgttgaaattccctgtcttaaaacaaggtggatcactactgatgaaagacacctgaggctgacctctggcctctagattcatatgtaacatgtgtaggtgctcactcatgtgaacttgtatacacatgaatgcataaaaaacacacaaagatgcaatgcttccccattcccgaatgaggatcggggctaagtcagcattatcagaagcagaagaaggttgatcacttctggagaagtgtcactgttagactggaaattagagatttctcagcctccactggtcaaaggaagcacaaggctaataagtctggtacttaatagggtcagatacaagctttcttgacaaggttcctcaactcccacttacaaaggaactttcctctgcattccaaaatatataattatcctagttgctggatacaaccttgttgattataaatagattgtcacctcgcctcctcatcaccctccaatatgtctttcatgctcaattagatgaacgcacttggtgcattttctaatcaagttttgcaaaagttaacccctgagcccatctggaaaagaactctggtgggatcctagtcacatctcatcttctcagcctctgcctaactgttcccactcaatgcatctctctccttgtgattggtcatcctacatcccaatgtagggttccaatcacagtttaggtatgaccctgaagcataagcttattgtagcttcacaaaggacttggatgatactgcccaggagtagggaaagtgacaagaagtctggaatatggcaatgccttccttcttgtggacagttatgggcgagagaagggcatggccttgttggacgttgagaggtctcccgaaatgccatctcatgtctaaggctgtgaagatcattgagcaaatacaggctgcttgcttcctcttcactttgatgagcacagttgggggtgagggaaggagacacaaaccaagaagcttaatcagagccaagagctcctagggaaaatgctttttagacttggtttctgatggtgagagccatagaaatttcaagcatattttatgatccgcacatctattttctctggttttgaactacataagtagataggtcttttaaaatgtaagtgccctaatctagctgtgtctgaaagctttccctactaaatggtagggctcatacctggtgcatatggtccaccagcggtgcagattgcctagacagtacagtgagcacctgtcctctattggatgtacctcaacttcaaacccaagtcataggccagatactctggaaagcactgctgtgctcttcactggaagggagtttccttctagtgccctagctgcccagcctttctccctgaatcttgaggtcagggctctggtttttcctttcctggggtcagagtttgctctctgcctatatacctcttgcttggattgtccctctttgggagtcagtgtccaaggcacagtcatctctttgaccctacagtacattgtcatgacatctccctggtggacagatcccctgcaggggcttgaggctcattttattatctgttcagtgttcaccaaccatcgtattctcagagtgaaagagtgatgttgttgcttgttttaattttgggaccactaggtcaggctcactttgtttcataaggccagagcttagggactgtgtcttcagctagaaacccagctaagccagtcagggttgggtctactggtttttgttgtaggttgtggtttgtttgtccgtttgtttctggccctgtgtagaggatgcatggggctcttgtggctctggacttgagccagtatgatccttggtgagtctgagagaagacatagccaggaaaaccagaactcattttcccatgtgattattagaggaagatactctttttttttaactagcagagcagtttaaagtttgatcgagacttttaatgatgatacagttatgcgtttattgtaagaacctttgaaaatacaaaaaatttatatataaaaccaatgccatctgtcattctacagacagcaatcatagttgggtgtgtttcattatgtaacaaaagttcctccgaaaacacaagtggacgatattatataaaactttaaagaacttattaattaaaagaacaaggtggctaatgtgatagtcaaatgatcactaatgttataaacagtgagtgaaagttttctattttctcccctcaccctagccttcaaagcctacagacttaactgctttttgtacattcttcagggggaggggagtatgttccagcatacgtctgtaccagtactcagttcatttgttacatctatttatttacattggttttggggctcctactcaagctccatgcacattaggtaagaaatcactttatttatgaatcacaggttcatcttctacttgatacatgtgcacacacgcacacacatccacacatgcgtgtacatagttgcacctgtgcataagaaagccagaagaggatgtcagatgtcttcctcaatctctctgtcttattcctttaaggcatggtctgtctctctctgaactagaagtttcttcttttggtttgactagttggctattgagctcccaggatcagcctggccttgcttggctttttaaataggtattgggaatgtaaatgcaggtcattatgtttgcatagcaattggtcttatccactgaaccatcccccttagcccatgctttattattttgaaacataaaagcctgtggtgacatcccattgctactatttcaaaaagcatttaaggagcatcagcaccctaccttccactcactgtcaaccacaaggatatccattccatcttcatttttgttgttgttgttgttgctgaactctgaagtttttttattttgttattcagagcatgttttcataatgttattaagtaagtaagacactgcatgcatggacaatctcacacacacacacacacacagagagagagagagagagagagagagagagagagagagagatgcatgggcacacactcctttgtccacctctgcttcttttttcaggatagatttctagaaatgcaggtctcatggcaaaggatagaaactccactgctgtgggtggatactgtcaagctgtgacacattttttttttcctgtagaacagggatatttctcttacctctgaattatttcagttgttttgaagctttttggaatcgtgtaggaaagcctgcccctgctgttacaaaacatttgagtaatatgaaggcactcaagagaaagggagacacctcctttcttcccagaagaaacccgggctggagcccaagcaggaaccagagagacacgagttcaaatccagatgttgctcttctctttgtgtctctgggttagttacctgctccttcttccagaagcaaacacacttgctttttttgtcccaagataaagtgaatgtggactgagagcctggcccctgggaggcattatccccattggtaatgactgatcagttgcctatgccatactgtgccgtcttcagactcagattaaaattgtgctaggaaacggttatcttcctcatgatgctagctcttctttgcaagatcgcttcaagatctaagcctatggcagcaccagggcacaagttcctaaacgacagcatcccttctagcatagccaaagtcttcatgctttggttttgtgacctacctctggttaagggagcttatgggctctaggtaaaccagtgagccatccacccctgtttttcctacctctttgacagagagctttttggcagccccatggggacagatacatcctgtattgctattcctgagaactttgaactctggaaaaacaaatgactcagacaagataaatccctgtgtgtacttgtcatgtggtcccttagaacattagtctatgactgctgttctcagatctgcaagcatctttttagttgccctgaggcttggcttgttttaatggcagctctgtatataacctttttagtatttacaatagggtcatggtgtcctggtggatgctgtgtccagcagtgttgtttgctactgaagaaatatcacggaagtcagccttccaaggaataaaaggttaggctactattactttagacaatgaggtatcaggaagtcaatgttctggatcctaggatcagagacatcctagaggaagtgtctctccatgtggctttcatgctttggggttcccagaatgccatcgaggcaggggtcttatggttgccatgtccttggtttcttgtcactttatctccaccaaaagagatctccgtgtgcttattatcaaaggccagctcagcatcacctgtgcatttaacaagggactggacctggtgcttacccaattctctagaaacacattctgaatttattggggtcagtatccaagaagtaaaagtacccagaggtatccttggggtgaattctcccagtaacattgatctttgggcgctaaagtctctaggcctttgtactcttcttcagcttcttgccaggtattctgtcctaggaagatgaccttgagtgaagtcggtcattctctgtagctgagcctgacactgaagaaagtaactgccaggggctgtctactgacagcttgaaactgggccacagatcctcgggtagggaacatggcctgctcatgtccatggaacactttgctgcagaatcctgtggtctatctgagccctgaagaagacaaggctcagcagaagatgacagaggcaaaagggtaaggaaaacttcctgatgggcagagcagatgagcagggccgtggacgtaggaaagggcagagacttgcgagcccccatacaaagcatcacatagaggacagggttgggaggctggcccactgagacatggccagagtcacttcctttgataccttaagtagtttgccttccagatgatctctgaagtctgttgtccccatccctttaagaaaactcaagcaacctgtgatgagccttccaaatgacctagagtgaccttcacgtgttgtcctccggctaacttgccttggagagctgggcttaacatctgcttcttctcatagattctggcttctaagacatggaaccttctggagatatgtgggatagcttttagggcaggtgaccaaggcctttaaaaccctacccagctactcatttcccttcagaggtgtgcaagggaactttagggtgacatatccctggtcctaagcttggagaggctaattgacgtctagatctgtctctttgctggggatcacaaagctactcaggtgatgacagactggcttgtctgaaagatggactctgaaaattcttcaaggttctcatgtcacaggcagtggctgttctgcctggtcagataccaaggttcctttttcaggttctctggacatcagaagttcccttcactggttcccattcatttccacagcctgtgttccttctgctctctaacccataccgtctcttgccagacatgggccacatctggagttcctgtcacacgcagctcagtttcctctgtgtgtcatcagaggccctgcttttactgtcaccatgatattttgggatgtgacgaaggaggacggatagagtgaccacacaggctggccttcctgagccttgactgatgtcccctgtgacatctgtggacagtaagcaggttcctggggtgatagaatttcctgttattcaagatcaacagtcaccaagccaggtggctccctgctaactgtcagctcgtacctgggtgtgggctaggctttgggtttctcctatattaccttcccctggatgcacagtgatggtgagtcctataagaaaatctgaaaggctgcagtaactattcctttaccctaagtgccttgcggtagagcttctcttaatacaggctggggagatgactcagccagtaaagtgtttgctgtgcaagcgttaggacctgaattcaatccctagcacctctgtaaaaatgtgggccttgtgtcaggcgcgtaatcccagtgctagtgaagcagagactggaagatcccctgactcgctctccagcagacttagccagccccaggtgtcagtggggaaacctaatgtaaaacaaacaagggggacacatctggagcaatgatacccgaggttaacacacgtgcatatgcacacgtgcatgcacatctgcacacacttgaaagatacacatatgcatgcacacacacacacacacacacacacacacacacacatgatgtttctcttaatgaacatgtcgtgctgaaactgatctgtgcagtactgctggtgcttctcactccttctcactcctcaagaaaggcagggaatcccttttcatccagcagggcttgccctgaccctgcttgtcatggcgtggtgggagaaacttctgagtttgtttctgcacttccttgctggagcaccccctgcctcagaaggctgcctagctgttcccagagcccactgggataagatttctaagctgtgaggatgcctgggcagtctgtggataccattcatagtgctgagagtttgggctagagtctttgaacaccagtgtctctcaacatagcagccatgcaaggcacagtgcatgacatcctggtatttacagcccacagatccatgggtaagacagtgactacagttgccaggtggcaaattaaggggagcttcaagtcagctagcaggtgcagcttcattattaattccaatcacagtgattagttgctatttagggatctggctgcttggtcacctccactgtgcttcatctgctgcctgcagcttctacagagagaaggcaccccatccccccattcctttccccctttgctgctcttccttcaaggatttatttctgaggagcttcaggtcagtctccgaactgagcctttccccaaagcaggagtctgagtaagtcatcccaggaaatgggcatgctggcaaggactggccctagcaaatgaactatgctatgtatgcttggtaccgatcacaagccatatcaggaggctagggaactataactattgactagatgaacagagatgttgagcaagcaggacagtttcctggggtctcattgccaggaagccatacgaacctcatttgagtccaaagctgtgcccttgttgagggattgaggtgggttgggagaacagcctagggttgggacaacaggatgcccatgtgccatcctgaacctgttctggagatgatgaagctgacggggatgcttttcagaggccaagacagtgagggaaagagcacccgtgggcccaggcttcctcttgcagtcactgggggtggggcagggtatctccagctttcatagctaatatgtggagggacctacttcttggaacagctgctatagtccaggaatggggtgatgccagatatagactaggcagtatagctggtgttgagggataagagccttgggcaaaagattagaatcaagtatgtagaacccgtgactctcgataaccaggactattgcctagcacatttatagaccacaatacttgtcaaaaagttggaccttcttggcagatcttgagcccttaaggtacatggactttttaagactcctgagtgatcttttctctgaagcctccctccccccagtgtaacaagcatgagtggtccccaacactgagcactgccacttaaaccaggaatagggacccagaagatctgggttactgtagctatctggagttcagtggctcaaatgaagggaaaatgggtaaatggggaccttgactttgttttctagacagaacataatctattgtccggcacttctatttatagccacccaataattaagccactcaggcggtccaggactgacggggctgcatagctggtgggccatatggtggctgtgtagggtcggtgcctggctaatggaaggaagcgggtgggctgggagagcctcatgctattgtacatggttcatttcttcacagtgtggttttggtcaacagaaagattataaatagcattcataacatttttttctcctggacctaaccttgtggactgtcatgttgtttttgttggatttcttaatgtcacatgtaccaacttatacaatccctactgaaaacctcaggtgtctttctcaactggcatgagggttagatggactctacatatgtacatcagactccccttctctaacagccctcccaggccctgctcttactgcagggtattcactaggcttgaggcatggagagaaagctactgtattttttggcttgaataactttctcatgccctggtgggaactactcacactgtattctgtgagcactgtgtccttgaggacaaaggagccttcgatggcaattttgttattcattcctgtctcattcttgggcctggcttctcaaaagtgtagtctctcaagatacccagatgtgctccatccagacccagcccaactcagcttggcgaccgagctagcatctgctaggttctaagctacagaggcaggggtcaggggaagcagatactgagaataagatgaacgtgatctcactttgcccctgcctccaaacaaaaaaagctatggctgcaagtggggaggaaggggccaagaatcccagcaccaactagcctggttcttcaaagcagctttcttttagtgcctctgacacacagtaattaagctctacttccggagttctaggacttagtgtgtgtgtgtgtgtgtgtgtgtgtgtgtgtgtgtgtgtgttaactgatagatactgatagatatgaattatatgtgtttggggctctggagatggttcagggtataaagtgcttgccgtgcaagcatgaggacccgagtttgagctcagcacctgtgtacgggccagttacaatggctcaggtctcgaactcaagcacaggggaactatcagaggcagtgggtccccaagactcaaaggccagtcagccaaaatagtgaagtctgggtatagtgatggactgtctccaaaaataagatggagagtgatagatgagtacacacacacacacacacacacacacacacacacacacacgagttacataggtttatggcatgctgcgtactggcattccgctgtgagtagacagtgggcggtagtcttggtaattagaatttccatttttaaaacattttatcatttcttcgcaatgagaacctttgaatcccccctttccgtcctaaaacataaaataaatcgctgtgaactgtggtcaccccactgggctgtctgtggcacaggacagctgtggtcgtctcagcatttatgcatgctcattttggcaaacagctgtagttcagtgtgcccggaggacagacttgagcccaggctgatgctagaaggcccagggcccttcctgggaaggtcacgccatatgctgctgtaagcagccccagttctgactgctggggtggctgagtgaccttcagccgggtcactcccttctctgtgtctgttttccttgctctgtagaacggagatacttaaccctgctgggaggattaattgaatgggcacttaacagacagcctgctaacccagtggcgcagaactgggatttcttcctttcccagcaagtttcctttaaagtctgagatgctgccaagtcgttaataatttgttaacaaacatccaagtgtcctgggtcagctcagaccacaaggcattgttttgggtaagtgaagaatctttgtgccctgttaatggttaggcccaacatgaggcttttaacctggaaagcctcaagtttagcctagcgagtttgctctagctcagctgtaccagggctatcgcggaggtggatgagaggtctgtatggatggggaggtggggccaggtgctggttgtgaaggcaggatttgaggatctgtgctggggatgggctcctgcaagcctcttgcagggcagagggcctgctggggcttgggttcattgttttgcaatacagatatgttctgtacctatggggcgccactgactgaatcattggggtttgttgtttgttttgtttgtttgtttgtttcttctttttaatgtttgtcttttggaggcagtcttgctagctagctcaggttggcctctaaccagcgatcttcctgcttgtgctgcacacccagcttgtctattaattaattaatttagagacaaggtcttactatatagtttttactctcctagaactcaatatgtagatcaggctggcttcagactcacagagatctgtcttcctctgcctcccagatgctggcgttaaggcatgcatctccacatctggccttgtctccagggcttcaggtcctctctgtttttacagttcttggtcccactgtagggcagagggtataggattgcgagcttactcatagaagcctccctgggctcgtctgtcctcggcaagctgattcccataggcagcctccccgtttgtgggtgtgctcagtttgttttgacatgaggtcatgaacctgtgccatagatatggatgtttagggaaacattagagtttgtttaaggttcttggtttcctgaagcacacactgtcaggtgtgtcagcttccatccagggacaggagattgaacaccgaggaaaaggtggttccagtattgtgaggagcgggtgtggcagcagtcccaagaaggcgccagggactgcagcttaagtcttatgacttgcacctgacttcctcatacacctgaaaataagccacgaccatcgtgagagctgcgcaggtgcaccaggatactggcgaatccattttggtggagacatgcccctgctgccctgattagctgaagctgcttgcctggtgaggtgacatggcctgccgtgagtggatgagggctgagagtatataagagtgagaggcccgggtcagagagagtgaaagatgggagaaagaaaaagatgagggagaaagttgaagcgagagagatgaagactgacgtttgctgaataaactgttgttagaaggactggtggtcgtgttgttcttgctggtcaagagcggacacgacacagtatcagttttcttcactcttgtttgaactcccagcaccctcttgcatcttagaacaaagagccaatctctagcaatggccctttgccagctggtagtgacaagctaccaacctacttttcttttaggctgtgtttgtctttgaagattatcttctattttgaaaaaaaaatacaattaaaagtatttattttgtgttgtgtgtgtgcatgtgtgtatatgtatggccatctgcatgccccaacaaaagcataaacatggggctcagaggatgtgtgggtcctggggaccaagatcagggcaccttgttcagcagcatacttcttcatccactgagcatctagccaacagctccttcccttctaaaacatgctatcagtgcagtcttcacctatggcagcgttagaaagtttcagtaaattgtattctctacagcaaagagaggatgggtagttagtggtacaagttgttggacatagaagctgtgagatgtgcatggttgaagtgctcaggagacactatgtcctcctgattgaatcaacccctactggcttagactcctttctgaagctccgtggtggcatatcgcaagtggctgggtccttcagctcagtagcggctcttccactgagcctgtacttcatccatgattctatttattgaacaagtgtttaatgacttgtgtccagggcctaaggtttcattgaggagaaaagtctattccttgagaagctgagaggggttaaggtcaggggtggggcagagattaatgaggcctgaacttcaaggtgtgtgtgtgcgcgtgtgtgcgtgcatgtctgtgtgtgtctgtgtgtgtacgtgtgtgtttggggctgggtagtgggtaaagaggaacatcactgtccataaaagagatacaaacttccttttcacaagctgagtgtgggcttatgctgagatttgtcacacagcacatatgttagcctgcttccccttggggtgggtgggtgtccaggtgcttggggagaggggctcttgatggcagctgtcactcaagtgcatgcatctctcatttcttgttgccactggtgctattgcacactgttcagaaagagaggcatccactggagcccattttccccctaaagcaacaaagtaatagtccatttcctattggtcagttcctccaaggggagtatttgtcagggtttctattgctgtgagaaaacaccatcaacaaaagcaacttagagagagaagggtttatttcagcttacatacttccacatcacagtccatcactgagggaagtcagggcaggaactcaaacaaggcaggaacctggaggcagcagctgatgcaaaggtcatggagggtgctatgtaatggcctgctcctcatgaccatctcagcctgctttcttatagcaccccaggtcaccagccctgtggtggcactgcctacagtgatgagctaggcttttccccatcaagcaaatgccacaggctggtctacaggctaattgttcaggttttctcacctgaggttctctcttccaaaatgactctagtctgtgtcaagttgacacgtaaaactagctgactgagggaactttctccagaagctgagagtcaggccttctggtcattcctggccatgtgtccagtcctcccatggtcagcaaggctcttggactagcttgggtatatgggtagctccttgtctcctatgactgaagctgaaggaagtttgagtcccatggtgcctaacataggagttctgtgtgcaggataagaaagggagaacttggaggctgagacacattgttaaaaaagtttcactgggataattatttaacacttagattgggcctagggatccattaactagagatttcattttctttccacataagattttgccccagagtgcatgataacctgaggcacacggcaccaaggcaggcatactccaccttgggagacagttcatatggggcaggtttgtatggggggagacatcgtatagcctaatatgactctgagcgcatgaaattaaagcagacactgggaccactgcctaatccctcacagcctctgctctgaccagcccagcttgagaagaggaagctaagcgttccctgatgctgttcttcccccttggagctggaagaggttttctgaggctttgcctccctaacctctgagtcacctgaaacttccaagatcctctcttggtccccacagttcttcctgatacccgtattatcccctttgtcatgctgtagctctactactgaggctagaatagaagtcttttgcattttactttctgatttcaaaaaaaatgttgatcatttacctttttaaatttttcaattgtacccgaatggatgtgactgtcaaaatgactgtggggcagagaccagatcaattccagactctgagttttctgatggtggactgggcactgcattctgcacacatcatgtatgtctaactttgcctttcctgttttctcattgttgggtggtaccataacacatcagaagcacatggatgagggccctcttgttttggacagtagcaactacctagtgcctagagcaggtcagtaaaaggtagctgtgtgaaagagtgtaatacaatagtatggttcactgccttcaatcgtcagggagaccaagtccctctggcctgtcctttggtgttgcctaacactggtcacctgaaggtgcagggaggagagggggaacagaaggaggagcaaggacatagtcctgagtctgacatcctgcgagtgtgagggtgaaccttctggcccctggcccagagtcacagtagcagcatctagtcctctgtcctttgtcctttgtttgccttgcaatgcaggctccacagaagctgcaagtcactaccatttgctgctgcatttactacggatggctgctctctggccacagagcattcagcttctgcttagagacctgctagttctggctctctctgttctgtggcctcgctgcaatcgggtaatccaggagagttgtgccaaccagccctttgcccttcttatagctttagagctctctgcttggaaagataaagggggatcatagaaatccctgggacactgttgtccctccccagggctcacagaagacccttaggatactagaggtgcggaggattgattatataccaatccccgtacaaaatcaagtaacatcaccctgttggttcatttccttcccaggctgttactattctggtttgcaatctgagcatggaaaccagtctatgacttcttcagtgctatgtgttggctcctgaaaccatcaggatagtaaataaccactcactgtgtgctgtctgggccggagtgacagaagcctgcaccctgatgtgctgtttttggggtagacactggacaagctggtttgatttagaaatcggtctcttatctctcacaatggcacaagcacagagggggacagtggcccttccggagatcacagagctgctattgtaaaaggcagctctgcagcctgggatatgatccaagaaatgaagaggacacagaggtattggggcctttgttgtgttattgataacctgtgaattgtaatcaaggcaagttgacagacgaggccttggcctttgttggccaacagtttattacttccttcagacttaattgccagcgctgacacaaaggtgtactgtatctttaaggagatgatggctcgtgggagttgctcttagatcgtcaggcaagttgtgcaaggatgaactgtgagtggataagatctcaaagcctccttaagctggtaccataggcaagaccttctcatactacctttgccaggtgcctgctttctgtgttccctggggcaatctgtagaatgctttggttactaagcagtgggtacagaactaaacagaattgtgcagtggctctgggaggacacttattttttttttttcatcttgagtgctgtgggttacatccaagtcttttgtgtaacaggagtgggccagactggactgggagttctaggcacagcttctcgacacatccatgaatgggattttaaagtgtgtcttacttgttgcgagttcactggtcaatgaggaagttgggtggcctggtatgttacatatctaagattccataacatagcctttggagcattatcatctttgaaagatagaaagaaatgatagaaacaaatattaggaatgggtctttgtgggaaactattataaaatatgaggctaaacaaggatatgacacagaacattccaaagccattagtatattcatgtaacatgttaattgctttcctatgactaaaatatgtgacagaggggtttgaggaagaagaggttttatttttgtctcattcttgaagataggacaccatggcagagaagggatggcagatagatcatgacatgctggacacactgcttctgtagtcatgaagcagtgagacaggacaggaagcggggctaggctacacaactttaagaatcatccccagagtgatccagttcttccagcgagggtcctcctccaaaatgttccacagtcttccaaaacatgtcaccacacagcatttgtactgtgcgtagaaacaggtgagtctatggggacatttcacatctgaactgcaacatatgcagaagtcaccaaatcatgtgtaggtgactgggtactgttatacccatgattattcaactcatccttctcatgatcatttgcggttgtgaggctgggctaggggtgtctaaagtggtgatgactttcctacctaggggacatttgataattaccagagacattttagttgttatgaatgcaagttagcattgtaactgtcatctagcagtgaaacccagaaaatgccaatacacatccatagtagagatacaactcctcaacccacctatgtgccgaggctgacaaaacggggccaaggtagcctcggccactgcctccatacctatgaccctaacaccgtgcagcttggtgaccctccacaacctgatataccacctagcttaccctggtgtgaagtccctgattcacacttctctagaaggcaagagagatgtggtcttatccttgcagatattctaacattcctggcttaagacccacatgcccatctgtccacatactcagtgaccatggcctggcacttctccagcccggaggctacagagaggtgaggcgaccatgagctaccctaccccccttccctgtctttgttctcaccccagtgctaagctaggagttgactttgctctgttgcctgagaaacttggatttcaaagctttctctgtctgccaagaactgttcctgcagacagaacctgagattccaagattctgcctcttggattactcatcctcatgaagttttgagatcccaggtggtctctatgaacactgtgggtacccaggctctggtgattctgctggtgcctttttccccagtaagctaaccaaaggcagtggtggaaatcccatcagaggctggcctgcagagacccaagtgggacctggatcagtatgtgcagaagggctctgccaggacagcttcaaggaaatcagcaggtgttgtctgtggcttcattcttaatttgcctctctcggattctgctccaggtagaggcttgttcttaccatggggccacgaggaagccaagatggctggtcactctctgcattcatgcctctgcatcaatcctgggcatattctcatcaggctctgctatcctttaggatgccagccatctgttgggtgatttgctttttccttgaaaggcagaacaaggaataattgacccacgggggctcggtcactaacctgttctttatcagtaacttccaatgaccatattcatgtttgacatctactatcagccgggaaacaaacctctggatgcacttgtgagggaaattctagatagcttccctaaggtaagaagacctgccctagatgggggtagtacaatttcctgggcttgggtcctagagtaaggatgctgagcaccagaggtcagtgccctacttcctggatgcagatgcagtgtgactacctgccactgtgattttctaccatggcggactgtgctcatttactgacagccagtgcaaaccttcctttcctgaagttgctttcgtcaggcattttgtcacagaaatgagatccaccatctgcagggcagtgggctttgtcagagaaggctgaatgagagaaattcacacagcagactttctcatcctccaagattggagcgggtggtggaaaacatcttcctgggaaatagcttccgtgatggatggtgacagagggcaaaatcttgggctccgccttcatgggctcagactcttgtgagtgtgttcatgttctgtgttgctatttcttccatagttgtttggtaactatggaaatggaaagagaggggatgagaaggtgagaagggtgggctctcttgtgcaagcaaccagcatagattaagtgttacatagctgcatgcagtctctgggctcagctgaccctcacagccactatctacagcgactttgaacatcaccctttctctgtaacccttaaggaaggctacagtgctgtccaaggatgcacgagtcaggaggtagcagaatggggatttgaaccaatttggatgccataactaagctctatattttatgtctctcatgagagcttcttggcatccagttgacactgatttcccaaaaacccagagctctaaacatgatttggtgtttgagaggggtggaaatgagtggctatcccacccaggatggtatcttcatactcaaaggcagcctctaggaagaatttctgggcactgtgctcggaaactgcttgagctgaatattagaactgaattcccctaggaaaaattttcaagctgtaagcaacacccctaaatggattatgaaatcaagttaggacattgaagcctatgttaataaacaaaaataaaagatagcaaagcacatcccttagaatagatctaggcaatatcccatgaatcccatcatgcacttactgatggagaagatatagatgggttgccatgtaagacatgctttttgtttttgctgttactttggaataattttatttatttgatattttctttatttacatttcaaatgttatcccctttcctggtttcccttctgaaaaccctctatcccctccccccttcccctgctcaccaaccacgcttcctggccctggtattcccctacactgggcatagagccttcacaggaccaaaggcctcccctcccagtgatgcccaacaaggccttcctctgctacctatgcagctagacccatgagtcccaccatgtgtactctttgatagttggtttagtccctgggagctttgggagcactggttagttcatattgctgttcctcctgtggggctgcaaaccccttaagctctttgtgtcctttctctagctccttcactggggaccctatagacatgcatttttttttaattttgctttcttttgatgttcaatgaacaatgtatgcatttatggggaacatggtgacatttcagtatatgtattcattatgtagtaatccagtcagggtaattagcatatccatcacttcatacatttttcattactttgtggtatggatattgaaagtattctaggtaggatcaggattggtaacatataccttaaataccagcactcaggaggcagccagtagcctggtttacttagcaagttccagacaagctaggactgcacaaagagaccctgtctcaaaaacaaccttctaggtatttggaaaccctgaatacagtattcagtatcatcaccttattgtgcaatagaacctcagagctgatactgtttacctgtctgaaattcaggcctgtagaacagtctccagccacacccctcattcccccatctccagactctgattactgctcttctattctctgtgcctctgagattgtggacttgagcctcctcagatgagagacatcacatgcttactgtcttttggtgcctgtaacatcccccactgccttctagttctgtccatattttaaatagcagggtttacttctctgtagaagaaataatgttccattacatatgtaccaccttttctcttccatcccacatcctggttcatgtggatgcagtatgcattcctcacttatgtcaaggcagtgggtttagatgccctggagggtaggtggactcatggcagatgttcctccaaaggagtgtggtacttggtcttctagtccccgatgaagacagtgttagagaaggtgagagggagcagcagggcatgaggcccattaggaaggagagacaggagcccctctgcaaggttctggtaggtgctgtggggctttagaggtgttccagacaaggaccctcctttttatatccctttccctttccaggcagagaccagctgtgctgaaaaagggaagagtctaggacaggaaatctagaccagaaaaatgacactcagtgccatgttccggaacttccctcatgagctccaggacagactgcatgggattaaatctcagctgtgcctcttccagctctgtggcctaaggcagttcccaaacctctccacctctccatgcctaattttcctccttcattgatactgtgtagtgatagtttattttgcatgaacttacgaggattccatggattgatattttaaggagggctcaggataaagcattgtgggcaaccctcttctttatgtcacacacacacacacacacacacacacacatatccagtaagttttgtcagagtgttcagcagaaagccttacaacaccaacatcaagctcttgaagatgactctacctgaagtctgtcctctcataattagtatccattgttcctatatggagagcagtatgttctagatactgtactgaaccctccatgtgtgttccacaatccagctctatgggacagatattgtgcctactttacaaatggggaaatgaaaggaaggggaggcaaagcaggcccaggctctggggcccatgaccttgttccagccaccccagcttgtctttggtctgcactggtgggagggtgctactgtctcttcccccttctggacagaaggagagtttgaatgtccctgtcttgcacaacacccgaaactagcctagagatttgctgatggagccagatagccctgtctgtctggggctgtggtctgaagatgctctactgttaactctgctctgcaatcagttccccctcttcagactcaaaacttcaggctctgtcccgacagatgtcatgacaaacagaactcagtgtattatcctgccaggatgctcagcccaacagattcaggtgtatgcagacccttgactgtggaggaaaagccatgagaattactggactttctagggcatttcactaaaagattccacaccggggactaaaaatcatcctctgttctcagacacctaggcaaggtctgtgtgctctctagcccagggtaaagtgaggccccactgaaccagaagagaatacagtaccatactgttctttctcccagcttggggtctgaggagggagatcactgttaaacaactcaatctgcaaatagccatggcattaaaagtgcagtgagcctgctagaggaaatggatgggttgctatgaggaagaagaatgaggggccctaatttagactcagccgtgctgtgtgcatctgtcaaaaccatgcccatccttcaaggcttgcagacataccaccgccctcattaaatctgcctgccactaacacttatctcctggcattctcaggttccccaccatgttctgtcttcctcgccaatgtcacatactgcctgtattcactttgaagcactcgtcttatttaccctgatggatcttcaactcccagagagagagagagactgtgttccttgtatgtgagcctgctgtgagcaccctggttttttgggagatgcacagcggaatgactaagtaaacacaagcattcattccgtaactctagcagctcgtttaggaaaggaacaaatctctatagtgaggccagaggctccagagcccacttgcctgagcttcactctgtttctttacagtgtgatgaagtacaggtgccttgacctatctgagctcctgaggcctcatctgtacaagatgtcagaaatgctaaagaggacagaagggctcctacaggtgcattgcttagactcagtcttggcacatagtgctttacaaattagtagtcctgtgtctgaactatctaaatctctcaaaatcctcctaaagccactaccatgtatttataattattcctattttgtagctcagaaaaaccaagctttcagagggtttggacctgttctagtttgtgcagcaaattaaatttaatacaaaaacaaacaaaatgaggcccaggtgcaaacccaggaacatgagtctctactaaaaataactttattcccaccttccccaaccacaaccccagagttgagcattgaacgtaaggccttacacatgctaggcaaaggttctaccactgaactcggcctcagaccttttgctactttttatttttttatttttttattttcagatgaagtctcactaatttacccaagctgctttgatcactatagctaagccaagacttagaattgtgagccctctgccttcttcttccaattagctggtatggccacccaatttcctgtggattttactgtggtgtgccagtctcctagctagccaatcttcagtactgtcctcagaggctgggatgtttgtgtctcagaagttcacactgttggccaaagactaaggttgtacttctaaagccactgaacatttgaaatagatgctggcttcaggaagcatgagggttaggattcttagctacaaggggaagagggctctggcctatctgtcttgaagcatcagatccccctctatttttccatgggtcctgatgtggaagttgtacccaggagtcctataccctgctgcagtatgggatcattgaaacagcaggaagctttcaggttctgtgtgaggttctgtgtgtagctgtgtgagggtagccagctctaggttggtgtgggcagaagagggaggaaggcatttgattggtctgacttctttattctgtggccttcagttttgagactggtctccttactctacatcagcactgacaagctgtgtctacattctcttattttggatccctcttaaggtgccaggctcatagctctgtctgctctaatctttttgagaataaaaaattacaccccttatttcccccccaggaggagaggggtataatttgtgactaaaaccagggtgctcaggctgtgaaaatatctactgcttagctgttgccatgtgaattagagatggcatttatagctcagacccagaggacaagccgtgtctttgtcactgaatatcctctcctggaggttccccataaaagtgtagctttcggagcacaggatgagagacagccaaacctcatcaatctgttcattcatccctaaattccctccctctccctgtctccttccctcttctcccctctctgccttcctccccaccccaaaataataacacaacttttgctaagttcaacctcaaggtacaaccctacaggacatcccattattagatgtctagtttccaaagagagagacccctatgcaaacactcactggttagctttgctgatgagaggagcagagggtgaagcccattgtatctttatcattcacatggtctcttgcagaggaaaaggcactggtgtgcattacagtttcaaaggagagttctgttgcctagggttacagcagggaaacaccacagagtgatggctctcaaatcacagaaacttattaccttccaatgctggaaaccagaagtttggaaacaaggtatggatgagccactgcctctgggatatctggagagatacttcttcctgtctttccactgtttctgctgattgcaaaaccctgggcattcctgggtattctttggcttgtggctgtataactcctacctctgtccttgttaccatatgggtctctctctctctctctctctctctctctatctctctctttctctctctcccctctctctctcggtgtgtgtgtgtgtgtgtgtgtttcctctagtagctttgtatctgaacttgcttacatccatccacaaaagaccctgtttctgaatgaagtcacctttgtaagttttgtgggttaagattaaggcacatcttttgaggggatacatcgcaaaccattatagataacatgttggaggggtggatcagggtttcctgtgctaatgaggggaagtagacatgttggggtttgagctggtttgaattttgtcaagttgacacaagccatggtcatttgggaagaggaaacctcaattgagaaaatatcgccatgaacatagcttatgggcaaatctagtggacattttcacaatcagtgatcagtgtaaaaggggccagcccactgtgggcacgtatttctgggttgggtaagaaagaagactgagtaagctatgaggagctgcttggtgtctgcttcagttcctgcatacaaccatattcatttgcttatgtatcatctagggccactttcaccgtacaatgccagaattaaatctctgtagtagtgaccctatagtgcttagtagcaaacagtagctttatgccccattgcaggaatcattacagtgggctggtccttgtctcagggaggcacagaggtactgctatagtttggatctgaaatgtctctggtgttgcaggcttggcccccagcccatgctgatattgggacatgaggatcctgtaggggtggagcctagtagaaaggagttgggatactggagagatctcctgactggaagattgaggctttagcacctcctgttctctttttcttcctgactgctatgaggtaaccaggcctcctctgccacatcctcacacaatgatgtattgtgctaccacaggcccaaagcaacagttcaaatgaccatggactgaaatctctaatctcttggtcttaactaacctttcccctcccttcaagctgattatttcaggtgtatattttgctatagtaatagaagctgattaacctcatgtttgcaaatgctttgaggaagtgtgagaagtgtggagaccatacaattgggaggcttcattgactcctggtgatgctggagtaggtggagaggttaagataggtcttctagataaaagtcttaaagactaggaaaaagtcattaactggcctgggtggagaagggcaaaactacataaggatctgagacagaaaagaggcatgggaggaagttcaaatgtacctgatgcttaaagaaagagagaccagaagtagtctttttatgacatggtcagatgtccatcgaatgtcagttactccagagcatgtctgagtgcaatagccaatcttcattgtcaacttgatacatctaggaaaaaaaagagtctcagcggaagagttgcctccatcagattagcctgtgggcatgtgtgtgggttattttcttgattggtagctggtataggaaggttcagcccatcgagagtggtaccattcctaggctaataggcctgggctatataagaaagacagctgagcatcagtatagcagcaagcaataaggagtggtgttccatggcttctgcttccattcctgcctccacattagtgccttgacttccctccataatagaccgtaacccataaaaggacctaaaccatttcttccatgtgtagcttttgaacacagtatttttcacaagaacagaaactgtgctaggactctaaagatcctgaacttcacccagggaattatggatatcaccaaggcgtgtagcacaggagtgaggggatggaatgctgcgaagtctcttgtgccaccacgaagagtgagtacaggcctggagcaagtacaggctgagtagtcacctgcagagggaggtagaacggattgcatatattcaggctcctgatgcttctgaccctcatctgttggtctacacgcccctgacaaccagagatccttgtttcctggtctctggctctgcactctcgactccagctgcttgttgcacacctgctgtgaagccatagttcctgtgtgttgacactctccagggcatgatcatgacattcttctctggtgattgatggatttagccataagactctactataaatgagttgatgacaggggaccagattacacagacaggcaggacaggggttgtggggactgttgaaaaacaccactgggagacattgactatgatccagatatcttggagggctttctggtagaggcagcctttaaactgtgccttgaagaatgtgtacaacttgataaggtgaggagtataataattaattcaacatgtgcttaatgacggagactagtaacagcacacaatgggtgcagggtcaaactagggaagccatgagcctggtcagtggccctgaagctctctatctggtttagaaatgtgaccaagatacttgagtgtttcatgctctcgacactttaatccaaggtggcaggaaatgtccactcacgaatgcttctctccccttaccattccaggtgcatccttgtttcatttcacagcctccccaggcaggtgcaaaccatgaaccacatcctcctaccatgaaattgtttataggcatcgcccttagcaggagccaaaaacaccttgtcacttctacaagtcctctggggtcctagcccaggactttttttttttttttttttttttttttttacctctctgacctttcagtttccccttctggctggtgtcctagcccctgactgttctaggatcaatgactttcaccaaggttttctcattcctacccttgctatacagggtcagcatacagggttatctgtagtctgagccttccatcctatgccaggagaaacttcataaatcctggcagtggagataggtccccctaagagcagtttgtctagttaatttattaaagccttatgaaaatagtgaagcaaaacagatccacagaaaggaatgtttttaaagtacaaaatagttaataattaggagaaaatctaagttgttatcagctgggtcaaaaatacaggaaagttggccttttgtatcaatgagttgaaccaaccacagactgaaaatatttgaaagaaaatggtgtgtattttagatttttttcttgtagttgttttattggggtagcatttgtattgtactagatatggtaaacagccaagagaagaaccaaagtgttcaggaagatcgtgtgggttacacacaagtactatgacattctatgtaatgattcattcattttctgttctagacctaggagctttataaagatggtatcttagtgtttttattgctgtgaagagacaccatgaccatggcaactcttaaaaaggaaagcatttcattggggctggcttacagtttctgaggtttagtccattattattatagcaggaaacatggcagcatgcaagccaacatggtgtgctgaagaaggagttgagagttctatatctttatccacaggcaacagaaggagactataagccacactgggcataacttgagcacatgagacattaaagcctgccccaacagtgacacatttctttcaacaagggcacacctcctaatagtgccactctctatgggccaagcattcaaacatatgagtctaaggggggagtcatatttatacagccacacatcatagagattccaaagcatctgcttggctcctgtggggtccccttggtagacccctaacatggaggatggtattatgatggcagcaaatggaagagccagagattgcaaggtaagacaggaagatggaagggttcaagggtcaggcttgctcttctgcttcatgtcactcttaagggaactagccttatttccttgagaccaagagtaatctaacaactttctccctccttccttttgtaaatgctatctagcacactggggaccaggcttccaatagacaaaccttgaggagacaaactataacagaacataagcatttgaggatttgggtatcctgaggatatagggtccaagaacaaaccccaggttgtggccaaaggagagtcatattaatggcattctcagaagcttctgtacagacccattcttcttggctgattcctcatgtctgatgttagaagactaagaaatattggttgccataatcagacagagacagctgcacagataggaaagctgagatttagaagtaacccagtgataggacttcaggagttgctcacagaaaagacctcttcccatctgtcagtcttagagacaacactagccgttgctatagaaacaggaggcttgtgggatgcctgcccaggtgatgcctggcagtgtttagacagcagcctctgtcctgttgggcttgtctctctgcagttgttagatggtggcaagagacttctgagatctgaaaccttccccaccctgccctcttcatccaagcactgacaaccactccgtgtcacaataaaccatgcgccttttcttggtgtctcgagtttgtgggtcctcaggtagaaatctggaagaacaaacaacagtttagaaataactcacaattaattagacaagttacagatggtttggagactatatttccattcagttctggagaggttcctctggggtagaacctatgtttgtagaaggcactgtatctgagcaggaagacagctttcacagggacagaaatctacagggctcttcactgtcttctaggaaaggtgtatgtgatccattttaggcctcaggtacaaaattgctttcaacagtagctctttggctattcagagtgggtgtactacatacaacgagatccacaggttctcaaaatcaaagagaagcagcgaggctggcgggagaaggtctctgtacataagtgtgtgggataagaccttctggcttcccattttctctgacttcatcagagggttggacctactacttggcaagcctgtcttcctaatcaaggtctggagacaaggaaaggatttaagtgcccccagtgttgcaaactgatgccttcagacgctcagcaagttctgtctgggtggaaaacttcatccaaagccagactgaatcacaccagtttctaagacattcctcaaccatgttaggcaagctgggttagaaggaaacctgatataattttggaaaagccttcctagagaaaggacactctcatagctgcctagcttctttcagtgtccagggttggagggatctcaggctccacagaggagcccagtgggcctggggctggcagggagacagcttaagttctgtaggctatgtttagtctcattgcaggttgtctagaaggaacagaagttttctgatccccatagaaataaaagtcaagttgtctctcccctagctattaagtaatggttaaatttcatagtaacaccagaatctcctatttgactgctgtgctaggagcctagattcagttagagtgaggacccagagtcttaggtagctgaactttctgatctcagccagggcctggcttggctaagtttggtttgcttagaggagtagctgtctaccttccatatgcctggtcactgactgggccatctttttgtttcatcatgcctctttgccctgctaggctttaggttttcaaatggaaacaaaaggaagtcagatagatgggcaaagtagaacaggtttctgacctctattcagaccccatccaagttcagcaaatggaaaatgcagacaaatgctcagccggtgagttctataggcacagatttgactaggtcctaaatcacagtggcgattttcctgaggtgggatgactgcttttgtaaacaagggaattcatcttgttgtgatggacgtgcctggtgaagcatggtcttctctgaggccctgtgttgtctgatcatgcctgtagtagcgtctgcattgaccaatacagttgcaaaggagtggcagttaagcaaacagctgtaggttgtgctgggagtcctggaagttagcctgagttaactagaggttcactgctggggactgggcttgcctctccggtgtctactgagtgagcagcctaaattcatcaatgcatggctcttcatcattttgctacatgccatatactttggaaaggagctagggagatagggaaatagctctttggataagagcgattgctgcacaaacacggagtcctgcatttgaatccctggcatgtatgtcacaaacatagcctgggtgtgtatgcctgtaatcccagtgctagtagacagagataggtatattctgggacccaatgagcttccttggccagccagtctcactagaaaacatgaagtatacttcagtgtgagaccctgccttaaaaatatatggtagaaaatggttaaggaagacactgtttccctcttcatgttggggaatcctcacagccatgtgcttgtgctacaagcatccatgtgtgcatgtgcacatgtgtttgcacacatgtgtctgcaccaaagtgctctctctctctctctctttctctctgaaagcttctagaattgaaatattacaacatgaagatataataagaaaacaagattttctagccctgtttagtattggaggaaagatgggagaagaaagaggaatctgcagagagatggatctaggtggaggacttcattgggtccctgggatttggtcagggtggatgaagatgtgggaaatgaagagagagtatcccaggagaggaacgaaatacacaaaggtgtggagtggaagtcagctggactaggttcagtcaagtcatttgagacagagcagtttagcacaacgtttgggagggcacagccacactggggctagaggacatgcagactgggcctcaagtacttctgcttttgagatttggacaggggatgcttggcaagattttaagattccaaacaatatgagtaaagaatgaggaaaagaacaaaggcaggtccactcactcagtcattctctcaaggagcctgctgaactccagggacacagctcaggaccctaaggatgtaacttgaacagattagggaaagaccccagctaaccctcatggagcttttgtatcatggccaattcccagagtgaagaaggtattaccaggaactgccaggacaagagcaagtagcaaacaggtggaaggctctgtgtcactttggacactgggcattggtgtcgatagcttatgggttactcttccttctctgtatttctccctatgtaaaggagtccctccttgtcactccccatacttgctgtgagctgatgaatactttaccactggtgactcaaatgatggcataggaccacagggaaaactgcagtgcttacagagaggcagggttagctctgcctatttcctgtagtagttacatcaaggacacccgatgctggaaactgaggacccagtagagtgggaaccatgtgatctcttccctctgtcccatgggcagggatcactgaaagttcaagctctgatccccaagagtatgttcatgagattcagacttttctggtcatgtcaggtgacagacacagcccgggctccacgagtgtgagtgtgacatctgggtgccttcacttccccatctgtagaatgagggtctgtactatgtaagcaatgtctagacttttcctgggagagtcaattaaactttaaaacacagaatttcacaaggctgccagcttcttattctgacaagcaaaggcccaacaaagaaactgtcaaatgccaactccaccatcattgtcatttccttcaaagggcaatttaatacccaaccaagaagtgatggcacaatgtcagagaaaaggacagctcttccccagagagagtgtcagctgtctttcactgaccctctacatttagttatgttggcctctccattccagacagcattctggacagtgtggctctgtgtttcatgctgttcctatagaaccactacacctaagagtcaacctacagacccttttacaatgcagtgtgaggtcccttgaggccctgatgaccttcatcccagtggtgtccctgggctcactttcttctctccctttttcactcttgaccctctccttgttcttttctgtgacttctctctggaggctggctgaccaattgtctaagagctaagagaacattagatgtgaggaaactggcctttctgatactgaacagacccatttaacggctgtaagacccccaaatcctcaggaccttcagctcttccttgttatttagcttccttgtctctgacagaatacctgccaaaatcaacttaaggaaggagacatttgttctggctcaaagttctaaagcacaactcatcagacaggtttggcatagcagcaggtataggaaatgggtggtcacattacacatgcagcgaggaaaccaagagagacccagattctgatgtttagctcacttccttctgtttgcgtgatgtaggtagggctctagcccagggaattctgttgctcaccctgggggtaaggcttcccacctcagctagcctattctagataattcctcaaacatgggtacagtggtttgtcccctaatgtttctagatcttgtcaagttgataaataccagatcccacccacattcacacccatgttttcacaatctgtcttttctcccctcatacttgaataaaaaaaatgaatttaacacaagcaatgaagattcctgatttctttcttaagcccatggcattgagatttcctgtggacctcagtggttcctattcttgtttatttcaatgagttcttgcttggagaatttgacagagatcagatgtgttactttgaatataatagattctagcatcttggtgggcagagcatggccaagctcacacaagtgcattgtttggcactgagagagtgccagttgctctccacagacttctcatcctcttactgttatagtcattatattatggtgaccctcacagggaccacctgaggaaatatttggcctggtttgccattgaggaaaccaagactaagataagttgatatagcttgatcaaggttgcacagttcagtaaggtggagccagggatcaggccttttataattctgacatagcctggctgttgtacacctctttcagccactttttatccatggggtctctgcatcagtttcttatgagtaccttatttttcaaatctgcatctcctatggtgttcagctcctcattcctaaaggtcacaaatgttccaaggtgcctggtagcactctctgtacaggacggcgactctgagagtcattttaatcttttttttttttccagaaaagaaaacaagttttgtagggttacatggtatccttgagacaagaaaagtgctcataaaatgcaaattataaggaaaagggatttgaaggaaatgagcttccggcagctttgtaaggccactgggctacatagggactacttagcacctcaggtactcatctttaatatgggaagagcagtgtttcactgtggtattggtaattggtaacagcattcacagagatagcacaaagcatttggacaattgtctctgttactaatccagctgacgctctggctttgcctcagacctgccggctgggatcagatattggagctggtcttcctactgggactctcgatggttcttttttctagtcagctttgagccattctatctgggtggtgctcatggggttgccctacagactgacagttcggtgtctgcctccttgcaggtcagccagctgccttagacttgcccaagataccctgacacaggattcatagaagatatatttgtttaacccttccaaatctccaaggtcccaacagtgaactctaggcttccactagtattattaaaggggtcagtcatcctaattctgcaaagatacatgtattcattactaaagcttgagggatgacttattaattggaagtagcaaaggttggcatttgagaacatgtctcatgcttcatgggtcagcttggcagtccctatcttaggacatttctccaaattccttttcatgcatgtctgactacaatctaatttaggttccatactatgttccatactatgttgatttttagaagctgtcacatgaaagacaatcagtgatattaataaccagcatcttgaagtgaacacctgtctgattcttggtacattgtgtccatatgggcaatcatgggatagaaagaaaacctggcctctatacttagtctagatcagatttaaagatcagttgggctactcatgagaatagtctcttgtgctgatataaaataaccaagtggagaacttggcctgctattgagatagagggggccaagaattttctgagggctagctgtccctatgctctttagtactaggagtactaggagtagcttatcaaggactctgagaagaactggatggatccctgccccacttcttcatgaccccagtgagggaaatgacatatgtgagaatgtgaggcccagagcttttgttaaaggtcacttggcctttctctacctttttttctaccacaaagacttctgaagtgcaattgttcaaacaggtgctttggagaaagaatctctggtatacctggatagcaatggctgaaaattcctgaagcatgtgaactgtggcagggacaactggtataccctggtggcattctaactccagaacagtaggctttgtctgagcttatttttaagcttctgtgttccaaatctgtagacaaggtccccattcctggatctgttgcccaatagtttgcaagaacaccagctggtcatttgggatggcctcatccaatgtcccaggcattaatgagaatgggtttctctgcagccgttctgaggaacattctaagcagccagggagaggatgcataggtgggtttcccaagggcagaaatgaattctgctgcccttcctcaccagctctggctgggacctgagggatcctctgctctaattctctccgggagtctcccatggctgcctcctctcagctgtccattcatagaactctggccacgaacatcccagctggcagcacccacattatgcttgagctgcttttggtaatctgcctaatgccctaatatgcaggattactagtacctgggggaatgcccatgttctgcagtcctcccacccaggatgtgctagaggctgtggtgggctttcttcttctatttctggcagtggggtgggcatgaaaggaggacagttcttcccactgtagatctggggagccctaggggcacaggaccaacatgatggtttgtatggaggcatggaggtatctccttcccttggggggatattttgagtcatgatatttcagagttttcagcccaagtaggctgcagaatgtcatggtcattcttgtgaaataaagccgaaatgggtatatggaaattacagactccccctcccttaaagtcacaaccactgatgtgtaaatggcacagagccttgatggtgggcaagagctcaaagatgcgttgatcagagtgccacaaggcctgggcctccctcccctgtccccacagcatggttctctgtggtcccccataagactggggctcctaggacacagaactatgggtttaactcactactccttgattcccaggtgtttctgttcagagaaaccagtcagggtgacactgggctatggacttcccaaggacaggtccagtttcaccaactgtcaccatctgtctggcaggacagaagctccttgtgccatacgtccagctgggggcatctgtgtgcaggtgcctggctcagcctgacagatggggaggggcacagagaaaggcatggagtgtggctgggaaggggtttaagcagaaggaacagtaaaactcagaggggaatctgtgtgtgcaggctcagggaaaacagcttactatgttaacctggaaaatgtgaaagcacagtggggccatgaggcccaagagatgaaagtttcttgttcttgccttctacaaaggctctctagagttggtcgtttgatctgtcccttggtcctaaggctctaggctccagcatgagtttcccaggatgggagatgcatctagccccttggatggtccagagggaaacggagaagtgattttttttttttctgatcacaaccttagggcatacaggacccaaccagggaaagaaaggcctagcacaccgaagccctgataagagaggagctgagcctctggggatgtgaaggacaagggataaagtcagatcttctcctgcatggtgaatctcagctctcactaggaaggttgcacatcctgtcagccacccatgttcatttccagtttgacattcaactccttgaagtaggatttatgtttctggagtggttcttggaggacaaaggatggtgttcctctgaccttgatttaactaacctcccgaggtgtaaggaccttgaggacagtcccctgaggtacgggtagtgccagaagtggctgcactgcacacatggaatggtgacagaccgttcccagaccctggcagagtcagtcacccccatattcatcctgtcctatggccatctgtccctgagatggcaggacagatttgtgtgcccccctccttttgctgtcagacagtggggtttaaattctgacagtgccttcttggggcagctgtatctggtaaatgaggacattagcacctacctcataggactgctgtgatcatgctcataatggcagccagtgtcattatcattactgtgctttttactaatattagccagatcctgtgcctgccaagaactgacgttcatttactgcagctctcttctatgcccctcccccttccctcttcctcttaggttctccctttcttcttttcttccttcttttcttccttctttccttccttccttccttccttccttccttccttcccatattctgcccctcttccttccttctccccattctctttcctccctctttcccttctctgttccccttccctctcttcttcgttctcttccttccttctcttcacttcttctcttttctccttcctccttcctgtctctttcccctctgtctccttccctcttcttccccttctttgctcctctccatagccccccccaccatcctccttcccagccctcctctttcttcctctacgccattaaaatgaatttgtacttactggagtctgcagtatttaagctgtaaagctgacagtggtctctcctgtgtagctccactgcagtgatgaaagtacatagccttccagatagacatgaaaaatcttacctagacagggatggtatgtccactagggtggttaggaaagggtcagggatcagatgagtgtctcaggcaacacccaggagacgagtgtgtggatactggggccgagggagctaccaatgctaacagcctctatgtagaggtagtcctgaacagttctggcagcacggggaatccaatgcagctgcagtgagaggagtgggtttcagaccctctggtgacatataggaatgggtgggacagtgtgaggactgacttgtcttcagagaagagaggggatatttcagaagggtgttgggcacagtgacaaagtgattatgattagcttaaaacaaacaaacaaacaaacaaacaaacaaacaaaaaagcctatattctcctttccagatgaccattgcctgaactactcttgaggctgtatctggtctttgctactacgtgggctcttttttccagtctttatacccctcccagtttcatacccaacaccagacagaagagaaaaaggatgagatagagagagagccctaaatctaattcttttgtttcttctttgactatggctgctaacaaacaacattcaacctccctaaatggccaacaaccacactctcagggaccctagtatttatataccctctgaaacattcccagaattccaaaattcacacaatcacagaaattatctgcagctggtaaaaccacatgtctgttagagcatgaggcaaatcatagtcagctgctgcagacagtccaaagcagccccacatcctaccggaggggactgagaccattctgcttttaggtgtctctcagcttcccatgcctactttctctaaagactttctttaccctcagactgcagcacttaggctagatgcaagtccaccatacagctgtgcctagttgagatgagtgggtgggcggggcttgggatagatagaactcaggggcctctgaaagaaagctgagggactctttactgggactcctcccaaggtggacactggtgacggggatggggaagctgtagcacagactcagtactcagggtgggagctttgccagcactactgccccactcccacttgtttctctgcctcttctgtatgcttctgtctcctcctctaagcatctttgtgtctgtttccatgtctggtggttggtcctcctgaggatggagcagtgtagtccaaaggttgcagcgagtatctctcttggtaagggagaagttcacacagtgatatcctgccttctcttgtcagtggtagagtcctcttcagggaagtggcaagtttgggggagttggatgggtgctttgccattcagggcaaagcatgtctgccatagaagataaggggagacacaaagtcccaggacccagaaactgcctcactgtgtacaaccctgtccctccttggaaaggagagattggtcctatggagccgagagccaggatgcatctaagacatcacttggtttagcctgcctagtgtgggaattccccctagctgtgctggatagggtcccacagtcttgctgggacctgcagaagtcttctgttctgttgtcactttaaggaggcttactctagaccaatggccttcccagggcccagtggtcctgggaagctgtgacaattggggtctcacttaacaccgcttgaaccgctgtgcctttcacaccttctcagagtggggtgcttctccccactctgcacaaaggacgcaaatgttcagagtcaacatgaccaaagggagtagagtacacccaagtcctcgtgggctctctgctcataccttgagcccttaggctctctgctgtcccaggtgacacctgctgtcaattactgactctgtaaaatggtctgtgaaatggcatgtatctgctggatttaagaaagatgaatgcacagaaaaattttacatcctaattgttaaagccagttctgacttcataggtggggatcatcactgctctagtaaactctatttaccctaatgcctctcacctcccctctcacctcctgcaatgttcccagcagggccactcaaccctccaggtcccacccccttccctctggtatgtggaattataacattagtagaggggtgtgggactttgccttctaagcacagaatcccccagctaacctggcaggctggcacagggcttgctgcaactccctgcttctgtggcccctcccccagtcctgcctcccacgtgtggtaattacgctcacaacatctagtgtaagcaaataataacaagggcattatcttctgttagtttgtgtttttccttgcctatcataaagcaattaaaataatgaatgccttgtaaaacaataggtaagagggttggtgaaatagcacgctatgcgccgtatacctcttgtgcagtgaattatagatgcattaaaaccatggtggctgcaggggactccctgcctctgggccttttccatgctgaaaagtgtctgtcctttgagacaccaggttcaagcagcaggaaattggccctcagaggtggcagccagagaccagttggctggtgttatgtgtagctcatttggtaagtgtgcttgcctagcgtgaggaaagtcctgcgcctgatttctagtactgcataaagtggtagtggtggtgtgtgcctataacctcagagctcagcaggtagaggcaggggagcttaagttcaaggtcgtctttgtctatataagttaaggcacttgaggttacctgagaccctgtctcaaaaacgtttgggttgaaagcacatctttcccttagccctcaccattcattggcctgctctgaaagtagcaggtgattctggctgaagaggattctaggagcgggctggggttaagtctgtcatctatttgggataaacaaggcctgtggttctctaagtcaacctcaggaatgaacatcagataaaactgtgggttctggagcaggtctggcactctgagtagccgaataccacttgggcttttgattttggtgctagcttgagcctgagaaccagtgcactccagtgtcaatgtcagatatgaggtggaggtgggacattttgggacttggtactgagttgctgttatgtgcctttgggcactgtttcgttctggggagctggcagttttgcccctgtccccatctcacagggcattccctgaagtggtaggagggctaggtttctgtttggactatgtaactcatctgccatggctgacaaagatcacatcctgccagtcctcctggagcctcagcaccaggactagagttaacagaccactgacaccagcctcggaggcttgagcagcagatgtcacacaaatcagaggggccccaaggcctccttccctcaggctcccactgggcttgttctagttcctgctgcttaaagcactggagagtaacctgccatgctcatccagtcctccagccccagcttctcagtcctactctaccagagccaggggcagctggaggagagaagcgggagtcagggacatccccaagaccaacgactcacccagtcctcccctcccccacttccctggtctcactgtgcccacccttctcctcatcaaaggtttccacctctgcctttggttcccctccccagtcccactttagtccaaagcacaatgatccccagtgtttgtctctttgaaaatgaataccagtattataagtgatgagtataatttgctgacatctttttccatctccatctgcattaataatctcagtgggtgtttgagtaggatctattgaaatttgattttagagtgacgagtctctagtgtatgtataacccatgtattttggacatatttatagagatatttgcttacctggaatttaaatttgactgagcattctatattttactttgtatccccaaacccagggctctggaggtgacaaagagcagatactcagaattctttgtagccattcatccaaagtttagatttcttggggttgttgttgttatttttgttttattttgttttatttgcttgggctctgtggtccaagctgactttaaacttgtggatgatcctcttgctgcagcctcctgagagtacaggtgtgggtcaccatgcccaatttccttcatatttactatgctagctttgtgtttaggactgtgtcaggtacagcagtgttgcagcaggggatgtaaatgaaataaattagtgaattatggactgtagatagagggttcaagagctatggagaacagtgaaacaaaacagtgacattgggagaagagagttaatgtttttcagagggtagtggttgagacactgagagtgcctgggtgaaaaacataaggaaacagaggcagaagcaagccttgagtaccaaaggatgagagcaccctagattcggcactgtgtgcaaatgtgtaccagcttcacacgggctctggatatctgaaggctctgtactttaagcatatttcaagtctgcaaggggaaacttattgcctcttgtaactcaaagaaccggactttagacaccgctggatgaaggcattcagatgatgacattagtgatccatgttgtcttcctttcagggaagggttcagtttccctgactgttccagcaagtggaccatacttaagtcttattggcttggcagaggtcatctgactctccctagtccaagcactaagggatagaatgaatgacctatctgtctgcatcattgctagatcatcgagaggccatcctgagtccctttggaatggcatagatgccgagggaaaggtggggcattagtaaatggaggaaggctggcactaggaaggcagggtgactcgtgcagagactttgtgaggattgtgacttagcttctctgtgacctgaggcaggcatgtgaagtggtcaaagaacagtgcagcctcctgtctgtcccaaggccgttctaaatggaaatttacgaaaggattcttcgggagccacagcacgcacgtggaggtcagagaccagttgggtgtcagtcttctctgtccacctcgtttgagctagaacctctctttggctggtctctgttgtgtatgctaccaggctagttgacctgtgagcttccagggatctggagatcctgccgtctcagtgctccatctttctgtgggagtgctgaagttaagatgtactctaccatgcccagcttgtcctaggtttggaggacttagtcttatgttcttgcacatgcatggaaagtgctttacccattaagcaatctccacagcttggtttttaaaaaataaaatccttagggatctctccttccccacctctgtatctttatgccacattccctcatctgggaaaccctttgggtttggattctttatgggtaaggatctgatttaaatccagctgtttcctatgtctcaactctggttctctctgttgccaggaggcccagaagataaacaatggctccagccaggcagatggtactctcaagccagtggacgaaaaagaggaggtggtggcagccgaggtcggctggatgacatctgtgaaggactgggcaggggtgatgatatccgcccagacactgactggcagagtcctggtgagtccctggcccctcctatatgaggtggtcttgtatctgcaaagggggtttgcttgtgagaggtgatgatgctctgatttttctccaggtcacctggggtgagtggccagtgctccacggagctctcagatcagcatggttatcttcacacatatctaagcctgcagtgtagggccatctgcagacagtaggccagcattgtgcactcacaacctgcttgcaggttacaccgaactttctcagtcagtaaaacagatgtacacatgtgggcacaaaatctctcatgcacacaccatacctgtatgatctcaggataaagagtggggtatagcaacataaaccaaaaccatgcccaaagtttgtcagtccagggctcaaaagtctacctataccacttatgagagagagagacagagacacagagacacagaggcacagagagagacagggacacagagacagagactcagagatagagtgacacagatacacatagacacacatagacagagacagagagacagaaacagagaaacagacacagaaacacataaagaaagagagagggagaggaagagaggagaatatatgtgtgcgtttaggcacacgctcatgtgtgtgttggtttatacaagttcctactgctgtcctctagtgacttgaagaacttgcttgggttcattgtcctattctgtagtgtgtgagcgagctcctgaacagcttctggtgtgcatgtgtgtatgtattgggggtgggatacagtgtgtatgtgtgatgtatgtgtgtattggggtacaatgtgtatgtgcaaggtgtgtgtgtgtgtatgtatgtgtggggtataggtgtgtgtgtgtgtgtgtgtgtgtgtgtgtgtgtgtggtatagtgtatctttgtgtaggggatatgttgtatgtgtgtatagtatagtgtatgtttgtgtgtgtgtgtgtgtgcgcgtgtgcgtgtgtgtgtgtgtgtgtgtgtgtgtgtgtgtgtgtgtgtgtgtgtgtgtatgcatgctgtgttcttatatttcttaggtgccctgtttctgattctgtcacttaggccctccacagttagggttcacacaggcacaccttgcctctcttatctacttatagcaaacttggcctcaccagtttgccttgtgagcccctgttttgggttaagaatcgtgactaaggcaggcttgctggggccaaagggctactgaggttatcagtgtttcagtgcaaagaatggagaagaaatgggcaggtggggatgtcacttatccctgccaggcccatgacctagcctaggtggcttcctttcctatttcagccctggttggtggcttccttgggttttctctgggtcaggagtttcccgctgatgcagccaggtaacttatccccaggactttgaaatatgttctgtgcaggtcaccttcttgggcttgaggtaggggttcagccaagagttaattggctggcatttagaataagcagggacctcatcagctactggatcaaagatcaagctgggacctggggtactatgtctagttccccagaaactgcttcttcagcaagaaggtgaatgcaaatgaagaaggggaggagagtctcactcaaatccttactgtcagtgtttaggataggtgcctgctggagggagtggggaaggtactccatgccctgcatgaggaactcagccaaattatctggtgggagagcaggaccctgggatccaaggaaccttctttgagcttaggccaaagagttaaattggcactagctgaaggctgacttcaaaagaggggaggtggacattggcacttttgaggacagagaaactggccagatcagttgctacaagggggaaaacagaggacagttaggacctttgtgaaccaagagaggatctgatgaggatttgcatgtggcttgctgctggagtggggggggggggggaacgggacgggacgggactgtcatttatcccctcatctaattctataggtagtttctgttgctcttccacacagagatctgaatagactttgccctagagacaaccgaggttgggttctgggtctgcatatgcttgtgcaacaggggcaaagccatgccttccacatatatggtggctgctctgtatagtaatgagaatgatatatgatagccatactttgaattttgaatgagcaagtttaagaacataagccaaagtaaaaggggaactagcacacagtgtatagatatccaagtatcatcaaactggtgtacaaagtatccagcagacatgacagacatgagctggaaaaattgagacagtcaattggaattcccaaattgaatgtccctccaccccatgggtaagcttctcatggctgatgttccagtttctccttcccactgtaggtactttattatgggatgggcagtagttatatccattaccactactagtactacattattgctagtgtgacatctattattatcctcagcctgttttaccctccctgtcacagagattgtgggggcagtccaccacaggaaaggagccttggagggctctgagacaaacctgcttaggtctgaaatagggaaggagcaggcccatttcagagtcatcttctatgtgagcccatgcagcacatgatgatagtttgccagtgtaatgtatgtcaccacagccacggcagacacagggtggcagggagggaatgatgtcatagttgcacttgtccaatcctcttgtctgatgaggtgggaaataagcacggacattagcagtagagttcttgcttagcatgcaccaggtcccaggttcaatgatgagtaccaagaaatctggagaaaggctaaatgtgatgtgcatcctaggacttgggaggctggggtaggagaatcacaagtgtaaagaaagcctgtgctacacatcaatatcttgctttagaaacaaacaacaaaatttctgaccagagggaaggggggactttttggttggtcagcggtcagctaggagaagtgcctaagacagaaagcttgctcactctttagtttcccctttcaaaagtagatgagcatcttgaaagccgaagggaggaaatgatgtcttcaaggaaagcaagttgtatgagcagcacatggtacatcattggactctggagattggtccaatgaggccaagggccaagaaggccaaggcattgagtttaaagaaggcctggaaggttgcctggagacagcttgtctggcctgagaataccaagctaatgaatttgggcagagtttctaggacaaggagattttgacagtggggtactgtggttgtctgccgtatagccacctgggtggaggtggctactcagagggagagctcctgagacaacttagggtagtgagctgctaccttagtgatagcatgctagggaagacaagatttgaagtgtaggtaggtcacaagttcagggaggtagagataggagtgatgttgtacggttggggagcataaggccaagcactacccaaacgcatcaacatggctaatgatgtactatcaactatgttatggaaggcatcttgtgagccctgtactgtgtcagccttgttccttgccatgggccatgccattgtattcactcacatatcctacatagttgttgggttgcagggtgttctagtttcattcctgttgccatgattaaacacccagacaaaaaagcaacttaggggagaaggggtttctatcagcttataattccaggttacagttcacactgtgggaaagttaaggtggcaggaacttcaggagatgtcaagactagataaagaacaaatgcatcatgcccatttggttgcttatttgtactcagctaggtttctcccttaagacatttgggagcccctgcctagggaatggtgctgcccacagtggacaggtcttcccacatcatttaacttaatgaagacagtttcctagagacatgtccactggccaacccacagcagacaatctgtcatcaagtctcttcccaagtgatttagtgttgtggcaagttgacaattacagctaacatggaggctcatcacaaggaagtaagctaatcttaccaaagaatctatctctccttgacaactgagaaaaagcatggctcagggagggattttgtttggaaaagagaaagcaaagcagctgttagtggcagagccagctaggtagatatatggacctcagaggctcagctcagtgttccttctggattatgactgcctaggtaaggacaatgccgtttctaagtctctacccaatgttgctctgagtgcgatgatctaatattactgtcctagagccagccaggtctgagaccccagtcttgaccatcttaaccctcacaggtagaagcagcttcaacccaatccttcttgcttagggctgtccaaggtgttagctgatctctggtctccttgaagaaagtcctgccaaagtgctggatccccttgaagggatggatccctgcagcacagagcagtgtctcagaagactttgaggagaatgcagagcctggctttgtacagaacacagattttaccagcacacaggacaaagctgccctgcatgatctgagcccaacactgtgtttgttttgagctgtccagatgtttatccctgtgacagtgggaccgtttcccttccccagttttcaatctgttttctttgatgcatgcttaggagcttgcaggtgagactattaaggttggaatatggtaggtaaggtctagctggggaaggattagctaagtagcctagattatctgtaacaactgatcttgctaagtaccacattcatttgataaatggtaatttcttaacagctctggctgtgtactccatacaggcacaaaacagtgagcaaaaacaaacaaacaaaaccaaatgtgagttacgcatactgttggattaaatagataattgtctagttccatcccaggaatggcaggtggtcggcagtattcagctgggcctcagcaccaaaatggtcagttctttgactccaaggtttcaggtctcagtctctctccttaggatcaagcttcctaaacaaaaaccagagaggctgatgggtggagctctcctctgaaacacgggcctaaaccataggttaacagagtgatgccatgcagacaaggtagtctcttcctttgtttcattttttaaattaaagaatattttctttaaaagttttaataaagaaacaaagtggtgtgtgtgtctgtgtgtgtgtgatatggttatgagtatgtaggcttatgtacctgtgcagctggatataaagaccaaagcagggcacccagtgtcgtcttccacattgcattgtgagaaagggactctctgaactgagaactgaacatttgggctaggctggcttgactggggctcttgtgatatgcctgtatctgctcccactccaccctgtcagggttgaaatatggagccatgcctgactttctaccaaggtgtgttagggattagaactcaggtccttatgcctactgcatactagctcttaaccacttagctacctccctagcctccaaattaatgactgtgaaagtaaaattgtgtctctctgtctgcaggtccatcatcaatgtattcaatcaatcacctatcaaaaatattggggcaaaattgcaactcattgaatgtgtatgtcctctttttcttccttttcttttcttttcttttcttttctttcccccccccctctctctctctctctctctctctctctctttctttctttctttctttctttctttctttctttcttttaatttttgtcatccctaatgaacatagtggagcagctattaccatcacatttacactgtgttaagtattgcaagtaatctagggatagtttcaagcctacgggaggatgcgcgtaggctttctgcaagtactacaccatttatataagggacatgtacatctttagatttgatacccacagggagtcttggaagcagtctcccacagatgctgatggacaatcgtagaacagtacatgcttattttagaattctggaacatgttggaagaatcgctgagaagttccattttaggatatggagttggcctacactcagtaagacttcaatatgaaggaagatgtctttaggattcttctcaaatacttgggcgttgctgaggatcacgttgcctatatttcacctaatttacttcaggcacacactcccggagaaattaaataagctgctttcactagaaatcatggatttgtcagctagcaccatgattattttaagttggaaaaggggtaatatttggtggctgttgtgagccaaggttgactgacctacacagagaagccaaagtttggattttatgtgggctcatttctcctacttttctcttttccattctctttccttctctgtcttgagttccttaattatttcctaatttgtgtgtgtgtgtgtgtgtgtgtgtgtgtgtgtgtgtgtgtgtgtgtgtgctgttaggtgtttcgtacatttttgtgagccagattaaacccttgaaggctgaagtggtatctcaagacagggggcaagaaacacatgggccagcttttgtttgttagtttgtaaattataaactcacaaagctaaaatcaatgaaaatattttagttcaaggttggcaaatattcctgttgtaaacattgttaggctttgtgaactatacagactccatgttaactacttcatctgccattttgatttgaaagtagtcacaaacatctacactgtttggaatgtgtattccaataaaactttattgacagaagcaggtgatggacccatgtgctttgtttcataagtagcagtttattctcttactttataaagcaatcaaaaggtaagaatcttatagaataagagtaatagtagtggagaatccatttacaaggaagaaagatgtagacacacacaaacaaacatacaaacaaattgccccctcccccaatctccacaaacattccatttctgaatagttacattcatctccattgttctcggagcaactgtcactctaagaaacctgtcttgtggctaatagtagctttaccacaaggtttgagccatgactgcattgcctggactttctgtcaaatcgatgacagatgccatggtttgtgattctcttaaagaactgatttccccaacacagtaactggctccctgggcaaagataaagccattagcattgttcatgttagttcattttcccacttgcttatgctactgcacttgaacgttgctccaggaaacatgcaaatataattccaccaactgaaaacatttgctatttgctttcacgtctaggggaggctttatcaatgtatggagaaacaaaatgccagtctcaccctttactgttcattctaaataggtcacatgggtatcatttgacacattatatacccaacccaggccattttattcttatcttcaggggctcaagagaaacatacatgctcagcatgcctttcaagcagaagccactgcattgggttaatggggtaaagtagctgtgctgtgcctgctgaactgtttgaacatggcacttgatcagtgaacctgaggaggggtgcacatgggcaccatgaatcttctttgtgacatgtgttactgtcattcattacttaccatggggggggttgggggtggcgctgatgtgggctgtgtctcttgtgtgtatcatagcccttatcagtgaaacacggtagcaaatttgcacacagcacacatgtccattttcttccctcttccccacatccattctttatcctttcatattttgggcaatgctacataaaactgtcgcagcatcaacagttactctatagagcagaaagaataggaatctttggcagttgtattatgggtagtgatgtattgctgcttctcttctgtcccattggaagccaacaggttttattggcatgaacacccttaagggaggggggttgagtcaaacgactcacatagtaattcaccaataggatttaaattatgcctctttattttatcctgtgtgagtatgttggtgttagtcaggaaatcatagatgatatgttatatttttatatggttaagtaactgttttgactttgatagaagaggcaccagagttatgacacttgttatttgtgacccagtaccatttattcagatggaagagtatgtcacaggagcggttgcactgatcaggctcctacctcaggttgcgagctgcctgttgctagagatgctcacaactgtcttctgacataactaccaacaattggccaagctgaatcctcactgctttaattaagtgccattgaatgcaagagatgctttgggataaaaatgatcctctgggaacttgaacagacttcatttcctagctgatcgtggggattgcccatgcatgccagcctatggatgcttacagaggcatctggagcaggagcgtaaaaagcttctgtactcacacaaacttctagtccttttttttttttaatttaaaaagatatatttattcacatataatattctgggggcagggcacgtcacacaataaagtcaacaaacaacttgttagagttagttttctactttctgttaccatttgggtccctgggattgaacacgggtggtcagacttggtggcaagcccctttacccacggaaccgtttcactggccagggcagcttcagtccttatttccctatggaatccttttcccatagcacaggagtgacgccgctgaacctacccaaccatctgatgcatgtgggccagagtggttcactgctctgttggtatggcttaggagcaaaagatcgtttttcgtattttcaaattactttagaaaaatctaaaacaaaatattttgtaacacatggaaagtatacaaaattcaaatttcattgccctcaaaatttaattgtcataaaagccatgcaagttcatttatattgcagctgtggctacttttgtaacacagtacagtaaggatacaaggagcatccatagagtcccaaactctcaccagcctaaaaacagttactgtctggtcccatggtaaaaaagtttgccaccctcccttgaaactggtgaaattcttcccaaagaattttctaagctgcccactgcacaaggtaatagataggatgtaatatttttgcagtctctgaacaatgcacctatattgcttccgtaagctcaattgagtcttaagtagagactaggaagcgatagaagctgggctgagtggccccaggctgctagcaagttctctgttgtttgttcttttagcaggttcagcctaggggctggacacagtctgcttctgagatcatcatagcaaagtcaccccttgcactttctctcatggctaccctcctgcagtctgctacccaaggcccttcatccccgacatccacagatccacagcactgtccttccctctcactgaatccttgtgtgaggaccatcctgattcaggtctgtctataaggcggggtctcagcccaccctggctgctggcctgtaaactggtactcagtgtacccagctccccagtgtgccccgtaaaaaagcccagctgctaattttactagctggcaggatggctcctctggccttcccagagcagatgggaaaaggaaggacagacttagaaatcagacagctctggagaaagaaagatccttctggcccaagagtttcatgctgaacaccacagtgtccccaaacattgttcatggtatggtaactcctatgcctttggatgtccaagagaatggggcctggataggggtagtacctacttttgcttttatctcaaccatttgcctgaccacctctctggaactagttcccatatatttattggtatattataatggaatgtcccttcccgccctgtttaacctctgttgggctgcaagctaggagttctgtccttcaagaagggtctgactgggacctcttttcagcagcttgaatcactggctaggtcatcagaacataccaggaggtgagatggaacactctgtaacaacaaatattctgtattcctggcaaggagctgctgcggtatggtccttggaatacagagggcctctgtgtgtgttgtggctgaagctgcagccaggctaccatccctgtctaacctctcctcggggctttcattctgggccaatagcttcatcttctgaagccacaatttcttcatcttgctggtggggagaatgccagactctgggtcttcctgttgtggtgataagttcttgaatgcatgccagaaaactgcctcttgtgtggctagtgctcaataaacattggctcccatggtttgtgttacctgtcagcccaggcacaatgttatagtggctgtcacggagagccatgaaggcagggaggggaggggagagggtaaaacaaaatttttttccacagagagagagagagagagagagagagagagagagagggagagagagagagagagagagagagagagagagagagagagagagagagagagagatacagagagacagagagacagagagagagagagttctctaaacactgagcaaggctgctgggcagttctgggtatagctagccatccctcatgtgggtctagtgtgggtctagtcagtcagtgtttgtcctgtgcacacccttcattcaggtccatccagggtctggtcttcctgagactggactggctcgtgccagcctgactcatcgttgtcaagctggccaggaaattctcacttcatatctagcctccctgagctgtgcaagggccagaggtggggttgtactcagctccctggagctgtccttgtgggcatgtgtgtcacaggaaaacctttaccaggataacagataagtctcaaggaaagagggtcaaatgcattcagtatggtctccatgcccagttttccctcgagacagagtgagcctgacagagtatgtggctgatttcagtgggcatgtcaacagcaccatatgtgaagtgtgtgtaacagccattttggtggccacagacccattgaaaagacatggaaaggtgtggcactttgcagaagatatgggtgaacatagtatgtacatgaatgtgtaaaagtatgcatgtgaggcatgtcctctggacaactattggaaatgagcccccattacaggcaccagatacctcttgtttcttacagaaactctgcacaggacaacagatgcaaactgaaaaaaacgggatgcttggatgctgtggggagtccctcgagcagacctgggacctcagcatttctaattctagtctcacatcctgcgagtccctgctgctggatcccaaggggtgcataaatatgtttatatgactaacatataagcggccttctgccttactgccctcctgcctcttttccttccttccagaccagtaagagttggtgccccctggaggcttagaatggaataggcggttcggagcttttcagtcagggcatgcagtgattctcctccttgcttctcgagccctcagaggtttagatgtggctacttgtgaggaaaaaaaaaaaatctcttagtgggctgtgactgcctttagaacctccattccagctgcgagaaagtttagtagagagactcaaaaatagagacgacggtggcgatgaagtcgctcacactagggaccacatgcaagctgatgcttccgagtttagtttgcgaggctatgtttaggaggaggcagacggactcgtgcctgtgggccctaaacactccaatctggaggactaggagccccatttagagagtcaggttccagaaaaaggcatcttccagaaaagacaattttagggaaatgataccacccagaagctaccatttggcctcagaatgttttttattataagaattgttctttcaagtttgggtagagagagaaagaaggcttggcagttgtttcttgcctgtctgtcttgaggaatcagaacactcataaacttaattaaatgcacccaagcctcttacgcagcagggctctgttttgcccatctagttaatttcagttaatgaaattagccatgtgctgatatggacagcccgggaagatgaagccagcaatctctgggtggtagcttgggtcacagtgtgtaaaactgcggggacatgggttttcatttaacctgggacttccaaggatccttccatctatgtgcctccgccctaggcaagcataccactgggcctttcttgtttagaagagatggttaatccagacagtaaatggactagtcacaccggctcttccacaggcatagaagtccaggatccagtagacgagctgagaggttcaagaaactctcttcttgcccattgtgtcagccctctcttttcctgtttaatgtcccccaccccacatattttgtgactatggctagagcaactttcctaaggaaagtagaggatagctcaccaggaaggagaaaaaaaaaaaaccaaccaaacaaacaaacaaaaaaaaaaacaatcgccatagttgtctgcacttacaacaataatgccatgaaacagaggccaggtcacagaaagagggtatttcaaaggacaacagttgcctggtttctggctgtcctcaaaccctgctagatctgttggcctgtgaactttgttttgtttgagatggtgtctccctctcaggggcccagagttcatcaagtagtctagaactgatgactaaggagcccagagatctgtctgtctctgcatggagtttggaagaccccagagagccatcttgaccatcctccgagcttctggagaaaggtctgggtgtgatggatttattgaagagtctatgctgaactggttttacggactggacacgcagagaacgatctatctgggtttctgtccctgcctagaggacaacccctggcaaaaggaaagctgacgctttaagtagctgttagggaagctaccatgattttatgatctgggtaacttagtttcttagccacctcagagttttccagaaggtttagattgccgatctgcagaggcagatcgcttggtcaagcgcttgcctcataacgacagtgaccccaatgtaagctctgggaccaacatagaaaagccatgtgccatggtacatacttaataatccctgctctgggcggctccatcctaaacaaaacaagaaacaaagtgtgcctgagagatgacacttgagcctgtcctctagcctccacaaaagcatatttccctgcttgctccagtgtgtgtgtgtgtgtgtgtgtgtgtgtgtgtgtgtgtgcgcgcccccctcccccctccctccccggaactccaggcccagtttgagatcaatccacacaggtacaaaactctcctgttaaaagaactaatggtgaacataaagccacgtcctaatcccgcctctgcagtaaccttcttgagtgaccttgagcaagtcaggacctcagagtctccatgggtaaaatgataagtgtcaggtgttttagagcagtctgttccttctcaggctccccaggctctgggctccagcatccccctacttacttacagccagaaaggctcatgggaactcgccttccttagacatggaaggcacttgaccctgtgctcagcgctgggagagctgcacgctcgtctttttcttggctgttggtcccattgggaggatgtaggtagatctgggaagtctcttcctggccttccatgaaggttagtgaatggtctcaagtcttcttctcatggcttacaggcctgggggggggggggcgtcactgcttttcactcacctcctttgatcttttccctgtctgaatctcttccacatagccacaaacatacaaagaaggggatcatctctctagaagggagtggccatggggttgacgggggcggggggggggggaggatgccacaggagaaggacctataccttccaaggagttggtttctttatagatgtttcagccttggagcctgcattagatattatttatttaatatttatttatttatttatttatttatttatttatttattgctataataaaatccctagaaagaagtgacttaaaggtttcagaaaccagaatttgtctactgtagcaggaaaagcctagggaagtcggtggctcctcacagctgtggcagccagtgcatgaggctggctgttcccagctcaaatggatggagaaacagagagtgtgggccagaaggggctaggttataacccataaggctaagccccacaaggatccacttcttcccacgaggcttcaactcctgaagttctacaacttcccaaagcagcatcctagatgaggaccatgtattcaaaacatgtgcttgtgggaatctgtgctagatccccttactgagccatcttcatggagtcagccttctctaagggatgctcactatgactctgggtgaagtgtgacagtcccactcacctacaatgatttgaagggatgtccttccaccagcctttgctttaggagaccccagatgacagatgtccctctctaccacctgggtagtttttgaaggtcatttttttttttctgtttcagagacaggaacttctctatctttgcatgtatgaatgtttcataagtggcatgtttacttaaaagaatgactgccagaggcaggaaggagtgaggatccgttaatgtggagtaaggtagcagactcagggggctaccaaacaaaaaatgaaaccctacgcaggctacctcccaaagttatgtgagggtacccaacgctgtgggtgatccatgacattcagattgcagtcgtttcccaaatgaagcttcgagttaacttcctagatgagctgaagaaaaacaactgccacacgccctcagtggactatttcaagtgtttccaatttaattaacatgatcctaagcaaaggatgtccacattcttgggaggaaggcttgtccttccctggtcctcagtgatgaagcattactctttgtcagttcaccttctcaggtttttccccctgagagtttgagcacaggaagccagtttccatagtcccctggcctgaagggagctgcacactgaggctcatggctatactattgaatagaccttgtagacaaaactcagcaagacactcaaaaatttataaaagcttctttttctttcgccctggactaagatggagagatgaaggtggaactggagtggggggtggggggtaagaatttatttctctttcatctaggtttgtgtctgctacagcctctggtcctaataatttctgctgtggaatttaattttcccagacttggattcctcctccttttgccaaaggtagtatagtctggaaatgtgaagtgacaggagaaacagcccccacttcctgcaagataattttgtgtacattaaacagacacattaagccatttagaggagaggtgtttgttctccggagtctggaggaaatctgaatttctaattctggactctttaataattttcaaaagaactgagggtactaattaactgtctttgaacttccttaggctgtcatctatgccctgatctcaaagtagggactgaattctctacctctatgagattcttagactggacaccagccttgggggtggaattgaacagactttgagatgtaaactaatatacagaggggaaaagacacaaggtcacatttgaactcccagctttgagtcaaggcaagaggctttatgctatattttttccactctattgtgattgctaagtcttggaaagaaagccaaaagagaaggaaacaaacaaacaaacacagtaaaaatacaaaacagcagcaacaagatggggtaggacttaggacttagttgagggtgtttaggacacagactgttttcttgctcttgtatttaaggattgaaagagatctaatccagggacttttcatttcctgggtccattcaggtggtgcctctatagaaagctttgccaaagatccacagctctgtaataaagagctgccaaggctctgccctaaagaatgtgactcatgagtaagttctgccatgagagaagactagaaggtggcctggccagcatggctgtgtctgccttagctatttgagaccatgtcacttgcatttccttaatgattaaactgaggtttgcctgaagtcatgcagttcgtcccaggcagggtgctgactagaacctgtctcctgatcatgtgtagtatgctgataactcagatctgtagggtagatctctcagagaaccaggaagcttgtcagcttcctgtgtgagccttttgcttttccttttctcttaaaaatttcttttcatactgcagcctgacttcagatttttccatctggagatttctttttagtgtttggaggagcagagggggcggatttcatagccacattgcttcggcagaaaaacagaaatgcagttttccagtgtgctgtgtccactccccaaattcttttagcacccagcgtgagccagtctcggccctcctactataaagttctcccagcccactcctggggtccattctctcatctctacagctgccttccctgtgccccactcccccagtaccataaaaagcttgtgggggctgatgacgtcatggtctccttccttcatagccaggacctcctatttcttcctgtttcccccgcacccccttcatgctctttcttgtcagctattcatactcacatcttaatggctgtgcctacaaagataaatacgttttgcctctgaccaaaagcagtttctggtctgacttgaatttcagagtctgcctgagtttgcaggaaggaagcaggggcagagtcctcggtttcatctggggagccataaaagtttgctaagagtttattatccccatcaagatgaaaatggaattccaaggcttcagatatgaaagataaataaccaggcaagcttccgcttccatgaaagccaagttccctttgctggttttatgagtctacctgctgtgccctcaccctggcattcatctcctggtgatgtcagataaagccttccccggggacttatgcaaaactgggatggaatagagaatttcaggccattggaggaatttgcgagaaggatgactgatcacattcttggatgataactgccatgcaatctcagtacttgctcttctctttccagtataatgggggttggaataaaatgcccattaattggaagatccaggttggcttagagtctagggttgtgaattatccagcctatgggcaatagaactgcctatagttccacacagcgggtggcggtggtggagcgactcttacatttaaaggtgcctaagattctcagatctgactcgcatgagctgctagtgaggacagctacgaaagatgcctgcttctgcatacagtgtgagtgctcagagactccacagctgcagtgagcctgcccctgtgccactctgggtggccattatttctccccagagcttgcttctgctctttgtgattggcagagtctggtgctaacctctcagctcctagctgtagcaaagtcctataggtttgccttcaatgttccctcccttacagtcctggctgaacccctggacttcttgctttactcaccctaccatattgtgtgtcatgtgcctcatcggcccacttagtatcagctgctcattttgtgtgtcatgaccagcgatatttccccaaatccaacttcgtttaggtctcccaattggctttgtgtggtctaaagctcagattctttatacaaatgatgaacacacaccctctttctaacacccccccatatactttgtgggttcaaatctgacctcatcttcaaaactatgttacaggtgaggaagccaaggcacagggagtttttaatatcctagggaagaccatgtgttcaatagacctcaggaccgggatcctaggatagaatggcattgatttcttcccctcctgaaatctacagtcttgtctataattcacctgcacacatgtttggcccacaggctgttgagccagactttctgaccttggctctgccatgtactcgttggtccagggacagaaaacaagagtaactacttgacaggagtattatgaagattaaattccctaatatttgtaaagtacttagaacagtagctggcacagacaaggtattatataatttgtttgttaatcaaatatagtaagttgtaggttccttgagaataggaaacatgttgtttgttttataattccctttgtcttatatgggagatgggggaagagagaccaagacttctgcctggcagttgctgacaatcatagtgcaaagaaatctagtttttccactataaccagtgttaagcacaaggatgtaagaatacaagcgtagtgacagcaactgtttagtctgtaagtctgttcccacaacctcgcacatggtaaggatgccaaggcacagaggtttagcatcctagggaagatcaagcatccaataatcctcaggactgggatcctaggatgggctgtcattgattcctccttctgcttcatgcactttccacctattaatgagtggaagaaccagacccagtgccacaggcctgctgtcctaactatacgagaggctgaggtaggggaatacaaattcatggccaatttggacaacttggtgagaccctgtgtcataataaggagaatgttagagatgtcactcagtgaaagagtgctcccttgggatcattctcctccccttctctctctctctctctctctctctctctgtataagtgtgtatgtgtgggtgtagtgtacattatgtgtgcgatgtgtatgatgtatatggtatgtgtgcatgtacatatggtgtgtatatgtgtgtgtgcgccagttgtgtgttgtgtatatgggtgtgtacatgtgtgtatgtgttgggtgtgttgtgtatatgtgtttttgtgtatgtgtatggtctgtgtgtacaggtgtgtgagtatggtgtgagtaatgtgtgtatagtgaatgtgtatgtggtgtgtatgcatgtgtgtatgtgtagtctgtatatatgaatgtatagaggggtgtgtgtgtgtgtgtgtgtgtgtgtgtgtgtgtatgtatgtgtagattgggaggagtgaaagatacaggatatgtagggaagcaatcaaaccaggcatttgttatataaagaaaagttttcatatcaggttgagtaagagcctgaggtcataaccacttatctagtggggcattttctgtagtggacacttaggccagctatttccttctatgaccatgtccagatgcctccacctcacccctctgctgccattatttaatcccccctcagccgtttccttctatggcaaagctagttttatcgtcttctccttttgagtcatttccaggataaaatgtggatgcaactgtgaatagaaaagctacgtcatcctttcctctttgatcagctttcatcataatgggtccatttggaaggtttcatagggacagacacaatgctcctccactggactccatcagccactgaatgatcaaggtgccagggaaaaaaaactagagtgaggctagctggtttccatggcaactgcttgctcaaccctgcatgcatgcttccttctttgcacgtaggtgtgtgtttgtttattattggcgcaatctgccagtgccccagcaactatgtaggtgccatctctacttccacctctgggatcagtctcagttttgagctagacccacagcccccccccccccccagttttgagctagactacccacctccccaggtggtggtggaggcacaagttctgtttggctagaaaatattctccctccgttagatcccatttcatctgtcagcgcagtggtggtgatctcaagggtgctggagatgccgttttagaacctttagagtcagacatcatcttggctcctgcattgagtcacaaactggctggagagctgatactgacgcacaggtctgcacagtcatgtgtgcgttgctgttctctggggatgtccatgagctgaccatagacaggaaccagagaaacctgggttactctcccagggtgactctgagcatctgaggaatggtggtctaaattaagatgacctggacctaggaaatttagcatgactgtgaaatagcacatatctgatttgatatgggttttttcttaaaatgatcacatttaagttaggttagttaggtaaaccatattattataatttttttctttttctttttaaattattaaaaatatcttttattctttaataatttcatacatgtatgcaatatatctggatcatacccattccaactcttcccttgtatctctgaatgtcctttttctatcttcatgttatcttctcttctgtttgatttatttattttttaactagcatgcttagtctagtttctttttatttttaaaagatgtgtgtctcttaggtagatggagtaatgattagagcaatgaactatatgattttaatgacattttatgcatatcctacctcagggaaatatacatgtatataaacatgtacatatatatgcacatacatgtatgtacatatatattataaaatatataaaagtctctcaggaaaggaaccacctcttccagtctgcctttagaagcctggataacatgtctagaagcctccagcataccttgacatatagctcaccagcagaactgggtcaccagcttggtccttagtccatttctgacaaataaaaaggggcactgaggtagacttgagtaactgaggtttacctaggaccctttcctccatcacttgcatccctgaacaaagtcagtgtgctaggaagaaggaagctggggagtagatctaccagaagcagataccaatatgccctatagcagtagttctcaacctgtgggccgccacccctttggtgtgatattcagatatcctgaatatcagattttatatcacaattcataatagtggccaaattacagttatgaagtagcaacaaataattttatagttggggggtcactataacatgaactgtcttaaaggatcatagcattaggaaggttgcgaaccactgtcctataggaaaatccacaaggaggttaatgtgtgtttgtgccggtggacacagtttgaccacttatcctacctggagttaaatattaaatatctgtctataattataaatgaatcatcaataaaatgtaaaaataagtgccctgcaggaaaatgtatgatagacaaaccaagagacagacagacagacagacacacacacacacacacacacacaatcacaaacatgggcttcatggcttgccttgtgtttcttttgagagcactggttcatagcattcatgattgaatacaaagcccagctattctgcctcagtcataggctctgtggccttgaaccagctccttttctgagtctcagttgcttcacctgtaaaatgggactaacagtagcagctgcttcatggagctgtcagtggctgtttgtatgttaacatgtgtaaagcacccaggaaaaatgtattcatgtttaacacacatgaaccaagatcagtggtcacgtgggactgctctggggaccagtggtcattcttgaagtcttccaaatgtctctaacctgcctttcacaatgcctctggctcagatgtggagcaatcaccccacagagaacatttggttggacataagtgaagacccttggcatatgggtttcctgttgatgtcccagctgacatcaacatttcctcctcaacattgaggcagttttgtggaagagaataaatggggaaaatggtctgtaaagagaaaacccttctctggctgccacctcagaatagtgggaattgactgaaatcgagccagccaccatactcacccagctccagaacagaaggcatttgcaatcaggttgcctattggtctcgaactcagagccccactttaagacctatttttaggagttagtgtctgtcaggagaggatttggagaataacccagggaatggggttgtcctggattaaaagtcctttcacagtcaacatttgtgatgaatttgtgacttccaccagtgttattctgacccaagggcacacacggagggcttattcagaaccacgggcaatgcagttctcgtgtgatttgttttcatgtcatcattagatctgaacaagctattcacttcacatcagttgttgagaggaatcgaagcttggtgctacaaggtgccacagggacacctgtgattctactgcgctctaaagagaaggacacagagctagggagagcaggtgacatgcctccagtgcacacattaaaagtatgtcggaggacaatacaccattctccagatctgttatttgatttgtgtacatattcccgtcttctcctctgagtcactgtctgtaactaggagctaactgctgatcatgtttactggagtactaaatagggatggcaagttttaccctcattttccatttcccatatatgtgccatatatatgtgcatttgtgcttttatgtatgttgatgtatgtctgtgtttatgtgtgtgtgccagtgtaaatgtgtgtatgtatgtgtagacctgaggttaatgtctggaatcatgttcaattgttcacttactttgttctgtgagttgtggtctctcaatcaaacccagaactcaccaccttgcccaatcttgctggctagcttgatccagggattcgctgtctctcctcttattttattttattttattttattttattttattttattttattttattttttggctgcaattatatataggctgctatgcctacccatcacttaagtggattctgaggaatccaaactctagagttcatgcttgccaggcaaatgttttaaccactgagctgtccctgtagtccctgcactacagggagagaaggtcccatgtccctctccagtctactgtatctacagctgaggcagccagtgtgggtgattagcctacttgccttagtactgacgatcctggtggcaatgctagaccaagtgggcactggatgcttcctgttaaaaatggcccagcattacaagatgagacacaggcgaggcaccaccagccatgagctggacacagcctcaacaagatttgacctcattaaggaggcagttggccagtcgtgctctacagttggagatgaaaagtctccacagggacttttactgataagctttcaaaatctgaacatccttcaggagagtttcctcatggctctttttctgttgtgtgttttccttcacatgtgcatgcatggtttactcattacagcttctctacatgcctttctctgtgtcttctgctcccttttcctcatacttatctacagacttctcagcatgaccacacctatgtgcatgtgtgtgtacatgcctgtgttggcatgttagatcttctgagacagggtttcatataacccaggctggtctcacacttgctaagtagcaagggctggccttgaaatcctgatcttcctgcctccatttcccaaaactgtggacaacatgcatacatcaccatgtctgacttattttcttttcctttatttttttcctctttcctctccatacctgttagtgctttgaaactgttcatgtaagtgagctcttctgtacttactggatagaggactattttagacttcaagttaaaacaggtaatgacttgaaagtctgctgacaccaagccatcattttgcttagttaaaaaccttctgattgcccactggacaatgtttcttgaagcggtgggaaggtctagaattcctgctgccccatgtttggtctattgccattcttggttatctgctatttaacctaacagagaaatcattaaatgtatactcttctctatcccgtcaaagaaaaccttgctattccccacatagatgaaatatttaattcctccctgagccagggacttctgattagaaaccagacaattaccaaggatgtcagagtatctcatcctggagtttgtaattgaacaataaaaatgtatatacattcagaggccatggaataagactgttaacttgaatcaaagaatgaagagaagagctgtctcttacaacatggcacaaatgatctcatgatgaataatggtcctgtcctgaaattacatccttactgccaagcagtggctgtagatgggaaggttaatggtgatgataattgtgccttgcatttacatacagcacccctgtctcagccacttgttaaggtagttgtcttcagagctggcaggcaaggacttatgtctttggaggtggagtcctgagaggacatcaaccctggatgcacagtattccttatggaaggatgcacaggagccatataggaagagcattttcctcccatgacttgctggcttggtgctgccctgaactgcgtgggttgtgtggctcagagtgagccttgtgaaggaatatgtaaaacactggcaggcggtgggcttattttttttcaagtcttaagtgctttaaatgcctagggacctgaagcccctctgcctctgtctgcttagagaaagcggctcatcttttgttctttatgctaaaagggcttatgcacctctaaaaacagctcctgtttctggtgctttgcaaactaggaaaggaataaacttctgtgagggctttgccttgtctctctctcaagtaaactaagtgctagccattcctatgttctctatgcaaaagggaccttagcatcagaatagttgagtctgacacagcttagtggtctgactccatagcatgtggatcttccccaagagccaaaacttctgaagtgatgaattttattcccttagagtctgaatttctgggcaaaatcataaaactctagctactttgaataaaggataggagtccacccacagaagctcccttcccagccagtgtcccacgccaggagttctggaagaccttgagcacttcaacacctgagcaaggagcttgtctctacttcccaggaagggcctgtcagttcatgccactgcttccttcctgaaaaactccaaagtcctctttaggtgggagcaagcattcaacaaagatttctcaaaggccctccacttccttttgtgagccaactaaaagagctcatccctagatagctctttgtctttcatgggaagggagctgtccctgcctagatgtggatggccatcatctcaaggcctgtgctaagagagaaggcttgaggtgaggtgggaagtgttgtcccctgagtagctgaaggtcagggtaatgcgaatcagaacctctggaggttcagcaggttcaggcatgggatgagctcaggagcaagctgatctggaatgtactctgggcagacttgggtagacctcattagccttccttctctccagatgtttctagctaaaaaaaaaaagtttctggctcttctgattttggtagggaccacgtgctctggagatggctattcaaagaattccccatgtgatatttgacatcatttgtttgtacctaagacacccagctacctttggctcctgagctatgtggagataatgctgttctaccacagagtcttctcttggaaggattcacagccatgtgtccccctgcccagggctgactctccttgctatgcatggagataatagtcatggagcatttgtgatgaagaaaagtatacagagcctgacctctacttagaatgttccagattcggtaggaagacagataaaaggtgtctgtgttcccagggttggattcaggctgccctctggtcaaagcactgccacatgaccctttgcttaccccactttctgccatgttaggagaaggaacatcttgaagacgcagaagacgagacaggttactgatctaaatatttgcaattaacagtaggtttcttatttgatacacgtgttcagtacacagataagaccagatgtgttgcaggtgacgtttcaaaggcagcctctgagcagagctgagagtggatgtttactagagatccttgctactactccaagggggagagggaaggatgtgagggacacagaggccaagtgtgaagcagggttaggaaaacctctaccaaccctagagaacgtgggacctcttttaaagagtctggcagcagagtcacacatcacctgacactgaatgttatcttattgtcaatcaacagtaggaggtagactgccccccaaagagtgtggcccctattgcacatctctctgtaactgagccccaccactgcttccttggaaatgtctttgcccatactagggtttcgtcaatgtcttaggcagtgtaccctttctgaaaggtgcctgcagagctgtggctcagaccctggcaccccagagtctcatgcagaactctgtagcaaggtatcatgtcaatcaacccaggcagatatcagatctgcagttgccagtgagtccctgtacccattctgctttcctaaggaagtaggtgagactctgccatgttaaactatgcccagggaccataaaactagctaggaagaccttaggacccacactcacatcccattctaaaggtactttgttttcccaagtttagaatagtctgtggcattgagggtagagcaggggtgatggagggttcgttagagtcccccagccttcccttgcttcccttgcccatcactagtttccccttctgttctttgccccagcggtttctacaagtgctgtatctctctccatcctccacagagtcctcactacttccccagcccacctgccttctttttttcatgacctttcttagctctcctatgttggacatagttttatcctaattgctacactctgtaaataccaccgaagtcccctaggaggctgagaatgtgtactcttaaagggcagggctgttgcatgtgtgtggtttaggactgtgaacctggggaagccatatttaagcacgtcctttccctaaaagataccatgtaagctgcctccctggggatctgagtctgagatttgctggcacccgccaagctcatgagctcagggctcatggagacccccagcagctacccatagagctcagtgtaatatggcctcatctctatgcctttacgggtctgtgttccttctgactcagacctataaaaggacacagtgtgtagacagactatgtgtgacccaagatgccatggctcagcatgctatggcccatgatgccagagcccacagtaccagtaatcactggattcactaagtgggagggtggcattgaaaccaatgaagccaaatttgggaaacatccaaagatggctttgaactcaaactcttgctgccatcccacccttgtgacctgccacttaatcacatggcggaggatttgttacgagctggagaaatgtgtaaatgtttagagaggagcgagctgcaagctgtaaatggccatggcatgtttatatgagactggcagctcaaaaaggagactctaatagctttgtattttattgttatttattttttggtggatagaattaccaaactgatggatggaaggattatttgagttgttaaatatttgggatttgccaggcttttgatgtaacatcttctggcaactactttagagtaaacccagactagcttagattaactcagatctgtgggctgagaaagggaagctggggctagagacggtgggaaccttctccttacttgcaatactaccttttgagagggtaggatggaccttagttgtacctggagaacagttgatctctgctacataaattgtcaaggtttggtggtgagaaagaaagggaggaaaggcccttggtcttgcaaagattatatgccccagtactagggaatgccagggccaggaagtgggcgtgggtgggttggggagcagggcagggggtggggcggggggaggagggaagggaataggggactttcaagatagcgtttgaaatgtaaatgaagaaaatatctaataaaaattgtttttgaaaaagaaagaaagaaagtacgtagaagagagaaactagaaatactgaattagttgctgacataaacagaggcccattggtccccgtttctgtgtcctatcatcaagagtacttctcatatcttcccagtggctttccactatggtcattgtgtgtgtctccctcctccactgcaaggcttttggctgtggctccttctgtctgctgaggaggtttgttgattcatctataaatagtccagcttgaatcaacaagggtgagctcagaatggagactcttccaccaggactttttaagccaccaactgtgatctgtaggttcctcttctaaaggccatctctgtccatgagagcaatctagtgggaagacagacaccatcttgtcttttgttaagtggatggcttaaaaaaatagagaagcataaaagtgaaaagtcagatggaaggaaacacgggaagggaggagtggggtgtggacctggctaaaaaacatggcttcagccttcctcactcgtcagtaattagggctggaagcaacagcctcatacactgttaagagaattaattgtgcatgcttgtatgtctaaagctttgtgagtgttagttgtttttgaaaatcattcaaggtgacgttcagtagtatgtggaaattaatttcacattctgccttaaagttagagattcctagggcttttacaatctcaccaaagcttgtttttgagcgagctctttttacagcaggggagagggatttgcccacattcagatttggcagcaggctgggtgtcaaggcacaaaaatcaaaacattggaaacgtgactgatgcaagtatagaatgggcagcgtcagatagtgcccttagcttattgcaatgggatggcaaggtggggttcctagtcacttgagataaagcgttggaggaaattggtagattaggcaaaaaagcaagctgatgtcttatggtgcgaatacagatataaactttgagatgacattttctgtggaaatggatcttttgtgtttctacttcatgaacccagtgttaacatttattcttcaaaatctgggcattttcactcataatatgtaatgagctggaggttctttcccctagagagttctctgggtggcttggtaaatcttgttccacctgtgacattaacagggcacactgcctttccttgtcttaatctgatggtgacaccaagtcttcccacggggaattgccccatggttcctttttgctctcctgctgggcacagaggtctactgacctcacttctgttcctcactggagaaatgagctttgtgatataactatgtcagggtgacttagaactgggcagggccacggaagaagatcgcacagtcttggacacagaggagcttgacatgcaggagaaagataaaccttgacaaacagttgcgctgccatttgacaggtaaaagcaaagagaaggaagaggtcagagaaggaagggggttaggggatggggagcttggcaaagtagagggatatgaaaggactcaaggaagggcacaggcctgagaagaaaggagttctgagctcagtaaactgcctgggtagagtgtggggagcaaggagtaaaatgctttgcattgagagtacaaatgttgagttttctatcacatgtcaccttctgtgattagcctgggagaatgcaggaagtgcctgagatgacagaaagccgtgctggtccatctgtcatggtatcaggagctggaacctagaccagactgaggagcaggaaagagatggagaggttggtaacagcccagcccttttatgagtgaatgtatggatagtagtcactgaccaaacagttcaccggttcctagaaccttctgtgtgacaagttcccagccttcctctgggaaggcaaataagtgtaagcacctgacaatgtcctagggagattggcagtttggctgaggacacagagcctggtcatagaagagctgtgtaaggtatggccatgtggtactgtggccaggggtcacatattatactgagcagagctcactctggccaagaattttgaggccagaacaaacaagagggaaacgaaagtgagggagccaggacatctgactcagagtgaaaacgtagtctgtgtttttttgctgtccaaaaagcaggtggaacagtcctacactgcacttgtgagaaacttagagagcatttacgcctttgcccttatctaaattacttggagtccttaatagtttgagcctttgggggaagcagagctttaggtcgcatgcttagagaggagagatttctggagaaggaacaagcacttggatggcatcgggtagatcaaaaagcatggaggggctgtaggtaggacctggttcttggtagcacctggaagccgcgagctttactgcagtaaacacacgaagaggtaccatgggttgggtgatggagtttgtctgagtcctgctgagaccttgatttcctagtggtgtgaatcgggaccaggaaagacttgcagtaagaggcctagtcaaggttgaccagcaaaacaatggtctttgaaactgtgggaacaggtgccatggagatctggttaactatggctatttggccagttggttgtattttttctctcaggaatgccagacattttcattttaatgaagtctcctggtattttgcacgttgtcaatagtcaaaaacaatctatgagttcagagacaggcctcttatcttcttctgggatcccaacctgtggctccttatagctaatgcagtcactgaaggtccttagtgttacaaagtaaggtgcttgaggagcagtgtgaatctgggaaactggataagaagccaggaacaatggaagcagagctatgtggtgtggtagccaggagtcagatgtgctttggagagctcaccctggccaaaaacctcaaggccaggacaaacaggaaggaaaataaaggtccaggagccagggcctctggctcagtataaccagtgtaattccagtttcttttcctcagtgtcagtaaagaagagcaggcagtgctggcttgcttgtgagcagcacagggctacttaacccttaacccagatatccttatttgagtgattcattgtcttcataagtgagactgtgacgagagttctagaaagcctagaggtggggacatctgtcacaggtgctctcggaggcactctctttgcatcaggtactgtgtgtgtgtgtgttttagtcactcccttaagttgccctgtaaagcacacaatactatgactcttcttcaaggtcaaattcagagatggtcattggccagacttgggttggaacaagattctgagctgctttccagaagatcctgccaccacactgacccatgctgagttcatcttatgcatgcaaccttatataggccatcaccttcctggagaagaacaagacagagaaatcccagggcttctctgactcacccagcaacagcacacttggcttctgccaatgaggccttatctatattgagattctatgattctaaaggccttttgcgtgctgacctcccaacaagagccaggaattgggggtgcctcaggtgcagactggcagtagcagtggtatgaagagtatgttttcatcaaatgtagatgagctttgtatagtaaacaggttcatagatgtctatagaagaggccatacaatcagcctgtcttcgaggtcctggtctggatgcttcacatgtagcatttgctgtttacagcattctttgccttcctattctttctgagtgttctcaatccccatctcaaatggcccaaagcttcaaagagaagtattattgatgtagttaagtctatttttagcctgcttgtggctggtgcacatccaatgcttgaagcattaaattttatatctattttatctacatcagcaactctttacccccaaaaaatccattaaaagataacagaagcagctatcttcagacaacattcaaccggctcatattttggttgcaaatatgtcatgccccatcttgctgtagccaagacatacatttaacaattctaaggaaccacagaaagaaacaaggggaactttgatggttcgttgagataggagggggcataccctctcgactgtgcagctgtgttctgtcttagtagtgcagagaggtggaaatagaagtaaagatgccctgttcccatcaaaaggtttttggggtcacagatctttttgattagctgctccccatgtgttcatatgtgttctttctcttctctgttttttactatctctgactgtcagagagccttccaagatgatgggaggcagccaaaccatgggcttctgatgttgtttgattccttcatcaggcagaataaggaggtctgaggtacaaataatgtttgagccatcagagacagtttggcaaatctgtccaccagaattgctccatgaggctttgcaggaaggggacccctatccttgaaggatgctaatgagtacatagcattgagaagaaacaaacttggggaattaaccagattggtttaatgaataaacatgggaacagaaccacaggttcctagactctatcttttatatggagctgaacagaggttaatagctggaaaatgtaggggaaaaaaaaagcaaaaaaaaaaaaaaaaccaaacaaaaccccccaaaaacaaacaaaaaaccccacccaggctaagtgagtaaaatatttgtcacacaaatacaaggatctgagttctaatcccaagaacccatgtgaagttgtgtgtagtagcacactccaatcccatgctcctttgataggatgggaggcagagacaggagaatctccagaggctcacaggtcaagtaggctggcagtgatgaagagcaaatcgatacagctttaaacaaggtttaaccaatgcctgagcttctcctctgacatttacattcacacatgcaagcacacacaaataatacacatgcatatacaccagacacatacatatacacatgcagcatatgcacacatacatgaacaattttttaacaaatatgccccaatatatagtttacattaagagcttagtctgagaaggtcttgacttataggtctttgtctggcatatgaatttctgtattttgtagatctacccacaaatctctagtgtagattatccactctagagaaggcttcccaaaccattaagatgctaattctgaaggtacatataagtggcaagacatgtcatacttgtgtacttgaaaactcatcatactaaacacgccaattatcttaagcttctctatagatttaatataatccccatcaaaatataagtaggacttgaagaatttctttatatggatgagtgtttgactacatgcatatatatgtaccatgaggtacatgcttagtacctgaagagaccagaagaagacatcagttgccctggaattggaatttagaatggtatgatgtcacatgggtgctagaagtgaacctaggtcccttgcaagagcaacaattgctattaatgaccaagccatatccccagatccctcagtaggacttttgaagatataaacacgccaacacttaaaacattttttgaaaagcaactaaaatcacaaacatgttcttgaaaaagaatctgtttaaaggaatcagacaacctgattttaaggctcattataaaggtatagtaattatgatagtgtgagattggctgaagagtagaaacacagatcattggaacacagtagcgaactcagattctaaacccataacaaatacagccattcactatttgaagtataacaccgaccaagtggaaagggatagtatttaccaagtggtcttgaaagagttggacctccaatcagaaacaaaaacaagattcagtgtaaacttcatactttatataaaatttttttcaacctgaaccatagttgtagatataaagaacaaaaatcttcgaagaaaaccttaggtacaatgccaaaatgatggtgcatgaaagatagatgggccaacaagacttcatcaaaactgaaacattattctgtgaaggtgactcttaagagagtaaacagacaggatacgtgagaggcagtcatatgcatattacaaaggactgtatgtagaaaagctatttgcctccagttttcctgctcttggaccatactccacagtggtacatgtaccgtcctttgcttgcagtctggagtacctcttcccatccatccgcacagggaagtaagttacttcttagtcaaaagccagcatgaaagatgctctcccagtgaagctgtccttgtccctgcctgacaaccactcaaaattgtcccgttgcccactctgggaagtagtgctctctcaaaatccagtcccatagattcctttgttgctgatagttctttcttgggcaagctcttgatttatctgtcagctggtatagaacaaatggttcataaaatgggggaccttactcgaaagtcaaaggttttggactccacccacagtcctatcaactagaacactgaattgggaccccagggctgtgtttattttactttgttttatttccagatggggtctcactatatagctcaagctatgatctcaccacatagttcaggctggcctttaactcatagtgatcctcctgcctcagtctcctgagtgctggggttacaggcatgaactttcacctggcagaaatgtgcttggtatacctgtccccaacctacagaattccaatagacattagaaagataagaagcagtaatatagagaaaagaggatttgggaggaggtgagatctttctagaactgtttctaaaatctaggaaagggcctatcaagtactcactctgtgcctcttgatttcattacttccttcaggggagatagaagccctaatgtggttacctgtggctacctggccatatgcaggctgggtttccgtttctgtttgccctggctgtgaagggcaccacaactaagttgcattcaggactccagagacagggcctacctatgttagccatatgtttcaggcaacagccatattcccttcttttcccacttttgttccagatactggttttcagttttttataagaatccttgtgtattttctcaggcttagggccacagaatttagtttatgtatctcacacagccttatagatgggggtcattataacccccactttagagatgagacatgttgcttttgaggagtccaaatcaatgtcagggcctctgaacttatttcagaagatgcattccattctacacagaaaatctggtccatgtcctacctaaggatgagaatgtgaagaacagaactacagtggtattaactatgtcacaccgtcacttctgctgccaccatccctgctgtttgttccgatatcagtgtcttcaccatcccagcaccatcgcctataaccatgccatcactgtcgtgaaatcacatcaatctcctagagcgttttgcagtttatatgacatagtagagacaattagtcccggtaatgaaacagcagtgttatcagacttgtggggggcaggggctcacatctttagcccgaccaagacaggctgctctactcattcacctgtcctcaggaagtcagggaaaaccaccatatccaggtactgaaaagctggaaaaggggatttggtcaatatgtcgacattgggacagacagagattcagtgatccctgccaagccccaactttgggggtcttgaaatgaagtgaaggcttaagtagagagtaagagtcactatgcccaagcaatatccagttaaagtgtggtccttcccaccactgatccaccaccgtctcttctgtaaggtggtctaacaagctgtggatctcctctgtgaaagctttcctctttgtctggcacaggctttatactttctctcctccgcgagtgatctccctggagacagtctattttattggtgtccattgattgtctctacagtctgatagccaaagtgaggggtacaagtaccttttaaagagtgtattcatccctgccaagtcatttatagcaatagatttaaatctcatgtgcccagtacccaacgactcacaatgtacctccttgaagctaactgcagctgaataaggaggacacactaaattattcacctcaccacagtctgtctgagttgattctattctctaaacccttatttatcattctttttataattttcatacttatgtgagaccgagatagaatcttttccctacttccaaatctgtaggaagtatattaaagatacattggacgttaaggttagaccgcttagtgatccaagaagagagagggaattgagttttaaaatttgggctcagcaagattcccatgggaagttaggtgaatggcctgaaccatctgtcatagaacaagcacagggaggggacagggactcagtactcatctggaaagttcacacaccaggctggatgtataacaaagtgaatagagatagatacagtggagatcaaagaaggaaagttagttaatgtggccatctaacatgggcacaaatatacagtgaagggacagtgtctattgggcaacctgcagtaagccatgctgttaccactccaaaagtcctctttccctgagcggaaggagaatcttcagctttagaacatctgggcttcagttctgctgaagttgtcacctaccttgtagtgactgaacaagtcaataaaaccatctctgggcaattgctggaaggttttctggggtgcttcaagttagagagatgccattgcctaccttaaaatggtttgggacagtcacaggtgtccacattcctcaggttaagagctggaccctgaggttgagtcctcgctaccatttggcccagttatctctgccttcagcttctttgggtcaccttagttgttccctctctgcagatggctcttgcccctcacttttcttagcaatctctctctaacagtgctctcttacctgcagaaagccccagtcaatccttcattaaaacgacacagaaaataaaagccctttgtttccttttcttccccaagcaggttagatttgtggtggctccatgggaggaggagaaagctctgaaagcaggtttacgttctagtccagctcctggtgactatatagcccaagtgatttcagcaactgctaccaagtaaaaaccccattttagcagaggcaggtaaacaggccatttcagccttttggtctacccaatccactctgctgggtatagggagaatgccatgcaggagaccaacatagtgaagtcttgttcctcccttcaggctgggtttaggctatagcaagttgcaatgagtttgagcttctaattgaggttttgctactcactgattgtatgactgaggaaggttaacatggcttcctggaatcaggattcactcattaaaaacaatcatcatattgagaaccagaagatagcttagttgctaatacaaatacaaggaacatctagaagaagaagaagaagaagaagaagaagaagaagaaggagaaggagaaggagaaggagaaggagaaggagaaggagaaggagaaggagaaggagaaggagaaggagaaggagaaggagaaggagaaggagaaggagaaggagaaggagaaggagaaggagaaggagaaggagaagaagaagaagaagaagaagaagaagaagaagaagaagaagaagaagaagaagaagaagaagaagaagaaggaaagaaagaaagaaagaaagaaagaaagaaattcacgtgcactggcagatacttgcaaccccagactttagaaagcatagataagtggaaccttagagctttgtggctagccatcctaaggtgattagtgtgtcctaagccaatggacttaatgagccctgtctcaaaaaaaaaaaaaaaaaaaaaaaaaaaaccaaacaggtgggtggatagtactaaagtctgccttctggctgccacattcacatgcacacaagggtacatttgtacacaaatatgcgcacacacattgtggtggtttgataagaatggctcctataggctttgaatacttggttcccatttgataaaattgtttatgaaaggctgagaggtatgaacttgttggaggacatgtgtcactggagtagactttgaggtttcaaaagcctcctccattccacgttctctctgcttcttgctgtggatcaagatataagctctcagctactgctttagcaccatacctgcctgcttgcttctatgcttctcaccacgatggtcatggaactcacctgaaactactataaagtaccaaatagactcttctgtaagttgcttgatcatggtgtcttattacagcaatagaacagtaactaagacacttggacttgcacacaaaacggtcatgttactaagtactgattctagcatcaagctcaccagacagtagcttctttatttgtggtttggggaaaccttgaaaattggcctttgaagtctaactgactgaatgaaggcgggcattagaagttaaactcttttgtgtttctagacgagatagttggggatctgtggaactcaatgcattgttataaactggtggatggaataagatcttgttcctgacctcacagaaccaaaaagcatgggaataggagtctttttaaatgaatgggaaactaagaaaggataggggtgacttgccttagggtgtggtcaggaaagtctgtcttaggaagcaactttgagctgagatcaatgggaaatgggcagtgcagaaacagggaaagagtgagagtctagctcctatgtgaggagagctgcacaggtttcagtgagcaaaactaaggcaaggaagactgtatcaagatacagccagtagcctggtgggctagaggaagcaatttgcagttttgtatggccagcatggaaactcatgaggggttttaaggaaggtggtaatagagtaattttgtttattaagacctgatggagttgacttgaagaaagattacttagaatacaaatgccatgttcacagggaaagcttatgcactctcccaagggccagcatgaggcagcaagggctgttagtgtctttggctctccctggctccaggttctgtggtagaggtgggacagcttgttgatgttaagagtctctgaggcttggagactctggtcttctgaagctctgtactctttcttctgcctttgtgactgagaattccagggagtagatatttcaacaatggctgctgtgtcagaattccagattgatgacttctttgcacaattggtcggaagatcaaggaaccggaagtgccaggcaggttaatggagagggctgaggaagctgaccttgtcacttgcagaaaaagactttttaagaaaataggctatttttgcctctcactgaaaataaggttttgtgttgtttatctcaaggtctgagggcgatggtgttcttgggaatttgtccccattgagaggttgtttaagtttggtaagcatcccatctcttctgcactggcaggtagattgtgagcattaaaagggctgagtgtgcccccttgctacttcagcttgctgagtacaatggtttggcctgtagggcaatggaggctatttctcttcatactgccccctttgtaggtgagcagctggtttccggagagcaagaggtccattttaccattgcatgcctttttatgagctaaccattggacaggatccttgggtaagcttgcacagacaaaatggatttaaatatataaataaaatgaccaagacatcctccaagtcttgtttcatgggctacacagccaggtcagagacagctctgtagaacttcctacacttattgattaagagcctgctcttttccaggcattaattacactatcatcccatgtttcccaatagtgctctcttacacagatgaggcaactgaggctcacagtggtgacacctggtgcccaaaggaatgaacatgcagacagaaaataaacccaagatttgattgcaagtattcccatcccattgttccttgtttaagtccatccctgcttccttagtgtgtgtggacatggggtagtgtaagtgactcattctcccccagtatatgtctttaatcttgagggtgctgtgggaaagtcacagttggcttctggcccgtcaggacctatcttctctttcatggtgctgtgtcagtatagccttcccttccccagcttgctaggaactgagtgaaataatggagacaaagggccttcagggagtagagtgtgctgcagtagtggcttaggtgctaatgggtagcctctattgctggcagtccgctgagggagacactgaacctgggtcagctacaaatgggcacagctccaaggcaacagagaaatgggccatggtttgcctggtcagaaattttgtcacctgcctaagctgcatctctggctcttgcttgcagggttgagtaggtacctgggtacactgctgccagcttacctgtggttgttcatgctagtatgttacccctgcttcttaaagttcagcatcagcctaggctatactttggccttaataaacagttacatggagatacatagggatggtggggctcccatgtccacctggatcagatactcttaacaagatccaggtacattcatgctcctcctctctgaagccatggctgtgggagtgggaggcagcagtagagttagccaggagcatctttcttattgcttttgtacttgtagatctttagctctcttgctccatctacccttaatagcagcaaatccaggagcagccttattattggaagaccaacagaactccaggcaagtggcacaatagccttctagcaaagaaggactcataggggaacacagccttgactggggactcttctagttctagaccatgctaagatggacattctcattcttgcctactatggcaggaggactagaattcagagttgggaagatgagcttggcgtgagctatgttcgatgatgctgaggagaagaatgaaggtgatgctaatagtagttaaaataggcaacagtttccactcacctgttctccccagcagaaacttagatatcattgcatacaattcagtcagtttcccttactaacaagtgttagcatcacaaaagagatgggaacacaaatgctgacagaggttaaatgttctgcccagggtcaaatagctataaggatagtgacttaaagcttgacctctcatcctgatgattccaaagtcagctctgtgtggcaaagcacctttcttataacttgggagcccagggtccttctttcagatgctccaagcatcattcaagttctgtcatgagggtgaaagacccagatctttgactgggccaagaccctcgttcctcaacccctcctgtggcttgcagaaattctggatgctgctttgtttttgttttgttttgttttccagatttttttgttaatttccaggctatgctagaatcaaaatggtggtactcaatttcttactgtgttttcctctggccatacatgaaatacacattgtgccttagttagggttctactgctgtgaacagacaccatagccaaagcaacgcttataaagataacatttaattggggctggcttatccattatcatcactgtgggagtatggtgcgtccaggcaggcatgatgcaggaggagctgagagttctacatcttcatatgaaggctgctagcagaacactgacttccaggcagctaggatgaggttcctaaagcccacacccacagtgacacacctactccaacaagtccacaccttctaatagtgccactccttgggtcaagcacatgcaaatcatcacacatgggggaactgagcctcatgtgaggatgattgaaaactttttggattgggtgaaagatgcttgaattcctagctgctccaagtgtccctccctacactcaaggcaacataagactctgctaaatgtggctgtctctgcttcttggagagttcatgggccaaagcaaaagtgacttcgctagcttggctgtagcggaagaggttgggaaaccacactgctaacctttgcatctgggcccaaaggaggaacagtactgagtactacctgtaaataatggctcccagaatcccccaggctccttctttctgcaaggtcctctggtcatcattacttctccaaagctgctaccattttagcacaggcttttttcccagatcatttatcccattgcatcctatctactggttcatctttcttctccaagacaacaacaggcttttctctaagcctggggtagccgcctcttttttctatgttgagtcagttccaaaaaatagtgcaaacatcaggggcataattcaggatacataatgaaacggttctcttgtgtactttcatcagattattaccgtccttgtagttgatatctaattattcttgtcatttcactctaagtcgttgtgtctctttttttatgtctttgcctctcagcccctttagttgccttgcaattgttctgttcattcatcagctgtccaccaagcacctacaaggtacctgtgaggcactctgtagataggagctccatgtatatgtatgatctaatcaggacacacgggattagagatgactcaggatgatgacacttcctaaactggctcaccttcatctcaggctgatatccctcatggaagggggattaattgtaggccaactgaacagttatgtgaagtggggatggggctctcatttctagacatacctcaagcatctcttgaatgaatagctcattcactgttgaatgaggccacccagatacacacgcactcattcctggagtcaccttctaattctaaggtttcataatgagagcatgctttcttcaggggagcaggtgtctggtagacttggactcctacgctgttcttccgattatttccggagatcggcacctctccactctggcttggctgcacttgtttctgtcacccccacagggctgtgttgtttgttcctggagcagagagacatctgtcatccttactgagccttgacagatgccacattcaaagaaccagcactggtttgaacacagaaagcagcggctgtgctgtcattgccaggatggctcagtataactattcccactgcctcctccccaggcacaacctttcttaccagctcttgcagaagcaacctttctgtgctgaggtgttctgaagacttgaactaaaagaataccaagctttgagaagcaaaggtgaggcaagcaatgggattacaggctatgataccttttgggtgacatgtacccatacctctgtgggctaggagaaggctagaacactgatcccaagcacagtggggaagacctggcaggcaggacaaaacctcctcatgggtgtgaacaagtctccttttgtctattctcgaaagtgcagccaggcagtggtggcacacacctttaatcccagccttaggaggtagaggcaagcagatttctgagttcgaggccagcctggtctacaaagtgagtttcagcacatccagggccacacagagaaaccctgtctcaaaaaaaacaacaataaataaataaataaataaataaataaataaataaataaaaacagaaaaaagaaaatgcctcatttgacccttgccatctccgagaaccagaacttgggtaaatagtatgtacatacacagaatacatggatggcattgagtattaaagactcccgctattacataagatggatggcctgaggttacttcaaaggcaaaacttggagcaatgaagataagaatatatgtgtcagggtcagaagataaaggagaaccagagataaagtcctttaatccagtagggaaatctttgaaataatttatatgatgcattatgttccttcttttggatgtcatcttattttgaccatttattaccaattctctatgaatcccagccgacaagcccgagagtgttcatggacttgctttgaagaaggctgggttgagagtagtcctgtttggcatgctctggacagactgtagccaggaaatgatgctggagccagatctgtaagccaatgagggaaaggggattatatgttttgtgtaggcaaagctgtcaggggctgagatttctcctagctccttctgattcttccatgcctctgtcactggtgtccctgggatttccagcctgcctcaccttgttttcttttgctttagagcctcttttttcttttagaagctgacatttgcattctcccagtgttctctttgcatttctccagatcatactgtgagtcatccttctctggttcttttaggccaggaagggactctgtactcatcagtgcaactgagagcagtcgtcataagagtgacagtctctggaatctacaaaacatcaatttgaataaaggaaacaagacttttaagaaagaccagcctttcccttaatttaaattactacatctcaggggaacgttaatttttaaagtagctcacatattccaaaatagcagagaatcctgctagacaaacaatgaagtttgctttaaaaacatgcctttattcagctagcaaggaagcaggggaaaacaagagatgagaagtgatgaatggaatatccatgagtggattttgacactaaggctaacttcatcatccctgtttctcagtgtgtcctatctaagcagagccagacagacacctctgactcttagccttaactctgacatccctttcttgagcgcactaacagaagaaatctccacgtctgtgagtgtcaggttcaaaaccgagacatgttaaccacaagagagacttatctgagtgagcttcatatgagaattctgccggcatctgatagaatgaagtgatagggttgaagctgcttaagttaagaacttgaagggaaggtgatggatcaaagagtggatgtagggaagttgtaaatctattcttcccatcctgatgagcggtgatttccatctatgaaataatctgacaatggaccgataatgggaaaagcaggcacacattttattatatacctaaggcatgggaatataaaacatgaagatgggcaagttggctgaaggtaaagaggtggggtgggatttggacttagaattctggaggaaagagcaggctttggaaacttgccaaatggctgtcagcaaacaagaattgtcttgtgaatggagatgacttgaccaacgcctgtagcatctgtcgatgtaattggttccttccaacctctcttttatgactcacctctgctttctcctgtgttagtctaatgttcactggctctttgcttgtgaggtgccataatagaacagcatatccatttctttcttgatgggaaaagccttggtgagaaaacagctctcttttctatacagctgctttagccaagtcttagaactgacattcattggttcaggtcaacgggcattcgtattttagggtcaatggagatggcttcaggatgatagatcttgtggtctgcctgggattagcaagcctggactggtacactcagggcagaggtgggaacattcctgaactagagggataaagaacaaagaataaggtcaagttttgtttctagaagcagcaattgatgcctatcactaaagttaagcatctactctgttatagtttggtcacaggaatctgaggagccagccccgatgtgacccacatttacattaacatttttttttgtctatttcccttcctgtaatacatgtattggcaggcttcttttgccatcctgttgctaatgttgaaagggcctccagagcccaatttgacaacatggatttgatcctatgatcaaggcaaagacaagttttaagcccacaccaatttctttcccaaccatagatttaagagattatgtgtgtcttctaggctaaatggtaatttgggggctgtcatcactgagctggcagctttggtaagagttttaaatctattgtcttatcaacttaattttattttttcattaaacaaatttcaatgaaattcctataactgtttattgccatatgcttgctagtgccccaggcagctgattgactactacatgtaaagccatgtcttaataagagtccactcatgcctattttgtaggagtggcatatggctgtctaaattcatgccaagcagagccttcagcatccatgttctatgtgtggtttgatgtatgtggatatgaaaaagatatgttctctactcctgagctatgtgtgcttgcaaatgagtaatgcatttcagtgggaatgaagcagaaggaagtgattaattttgccccaagtctagtgtgggaaactgaaaaggacatctgagctgggccttgataggtgagtaggggtttcccttgtggatacggtgtgggaagagcccgttctttaacggagaagggcatgagtcttgtctgagatagagctgttaggtttaaggacatgtgcgatcactcttaccttgtctcttcactcctcagctggatggccccaaggactcacatttgtgttggctcaggtgctttctttctcaaagaatagaaacctaacaagctggctgcaatgggaaaaggatttaccatcttatctaatggagaggcatagacttgaacagacttagggactgcttgctctgttggctagataggatcttctcggggtctgatttctttcctttttattgtctgctctaaaactatgatgtcttcatcacatagtggagttttggggtggaggtggggctcagacgttgtggaggtcacacacttctgttgtatactttcattataatgcccagcaggaaagatgtccatttttatcctagcaaccccagcccaagtggctcgggtcatgtgaccacccctgaaccaaacaatccttattcccataggctagagatcattgagagactcggttgtccttgctctgccaggatccttacatggaatctggggtattagcagcatgaagaagggagtggtaggtcctgagacgacatccagactgagaggaaggcattaaagaaatgttcaccaaggtctatgtttacacccatgcagtctcaccttcccgggaagtcaaggaggtgggtgtcactgacttctgatcgtaatgctcaatctgtactttacctgctggttttcaccatggcaagcccacctttgtcactctccatggtctcttgctttgcccaggaacatcccttctctgttgatttgtgataaagtttgtagcataatggcatgaggaacacagaatgatctgaaatgttgtggcaatgactgtccttggactcattcagatgtaccttcaaagaagacaggtgatttgatacttataaggccaccaccacccccctctctgtagcagggtagctaaattcattttcagtcataggatggcaaaaaaaaaaaaaaggaaatgttttccaaaatgccttcgcaaaatgccttccattgataatgagaaaagtgtctgaggctgttagctattgtgacaagttatgtatgaaatacaattgagatatgttagccaagaaaaggcaagtgattggaggtagctatcagcctggcatcatcacttattaagaaacagtaatgtctcatggggagaaagaacccttgcatgctggctgttctgttggtaatctaggccttgatgcaggccccactctaccatggagcaaggctgaatcattcattcaacatgtgccgtccctcttgtccttccccttagctaggtgggtagaggatggcagctacttttgtccttagttgtttcatcagtggatggtggaatcagacactgtccacatcataaggttgtgaaaactggatgggcccatcctcattctaccagctggcaaatatgtattagttatgttactgttgttgtgttagaacaccacaatgaagacaatttatagaagaaacagtgtgttttggcttctgatgccaaagggttaaagtccataatggtggggacagcatggcagcaagtggcaggatttgtgacgtgcctagaaagctgagagctgacttctccaacctgaagcgtgaagctgatagaaaactagaaatggcatgaggcttttaatctcatatccctcctccagtgaggcatacttcttccaacaaggccacatctcctaaagtttcctgaacagcacctccaaccggagtccaagtgtttacatacctgagactgtagaggacacttctcattcagactgccacaatatatgtataatgtctaactacaaataattgtattttgattagatatataatgatataggtaactgcacacacacacacacattcctattctcctgcataatatgtagaaaatatttgcatttctatttactaagctcagtaagtatggataaacagataacaccatggagtgttgccaagaacctaagagtcattgcatatagattatctagcatataacagactcttgataaatgccagccattataataattattatgttgattgaactgcttaataataatgggattcatctgaacagagcggtatatgcttctgtagtgcttggtgccagcactgtccccttggtccttaaaattgcttaatgacaagggtcctttcctgttctgtggatctcagagaaaggctttatgctctttctctgtgttttatgtccaggggtaaattgcaggatgaggatacatgcagtggtaaagtgtttcccagttcagggtttctgttgcctattctggaggcttcccagctatttgtcacagtctcatttgaaatgcatgtggttttcatccataatatcttgattgtcccattaatctcctttaagcttcatgaaaaatatagagggctggatcccaaatagtcaccaagttgtaattttgcattcaagggagtgtttgccacagacgtgaagagactgatgtccccgtttggcaattggctttccaatgatgtcagaagggctgttgcattctgaattaacaacctgttggcagggctgcagctctattttgcttctaatatgtctctatctttggctgattctttatctccaagttctttctcttcttcccagtggatgctctgtactagtacctagaggggtgttcaggaatagcttttgctagagcagcaagaagcttggtacatcattttcccccatattcatagctatatgcagtgctcacccagaaagaacaggctttgttagatcaaggagcacacatcagactttaaggttctgagctttaggcttagtttactttttaatatagcgatgttaaaaacatgtgacatgttatttgtattttagtaaaataacatgttaggggtagggtgcatatctcagcctgtaaagtgattggtaggtaagcatgaaaacctgaatttgatcgccagaactaattgtaaaaaagaaaaccaatgccttgtgatctgtagttatagctcaggtctcaggaggtggagaaaggcagatcctcagggctcactggccaacccgcccagcgtaatgagttagctccagaattatgagagaccttgtatcaaaaactaacaactaagcaagcaagcaagcaagcaagcaaaggaacaaacataaaaaccaatgtggacagttcttgaagaatgacactagagatacatgtgtccatgctcctgtaacacatgtgcccacacacatgaggacacacacacacacacacacacacacacaccgagttaaaagttctagtccttatttgcactacttattttcactagctacgtgtgattgcctttgtgggaaacatttccattaatggagaatggtggtcaagccaggaatcagttggaaagcatccacagtgtatgattcatagtatcacagaccaccaagagccttttttaaactttttctgctgtgtttcccctcccatcatcaatccacctttagaccaggagaaatagcttctttcctgatctatcatcaacattcaatgaaaagatgaaaaagtcatcatagagaatgtcaatgagtaattttcttcctaatatgcacaccacccattgagagcacaatgcatgttttccctcattgttgactgtcttgggtgaagtgagaaagtctggatggaagaattttatactagaatctagtgcctgagaagtcagcacctgtcaaacactttgaagtaatcctacccaacctgaatttaacattttctgcctgtggaccactctggtggacaaatccactatacataacttggtctagtcattcagctccaaaaaaaaaaaaaacaaaaaaaaaacaaaaaaaaaacaaaaacaaaaaaaaaaccaaaaaaaaaaaaaaaaacaaaacacacacacacacacacacacacacacacaaaacacagagtagacattattggaagaatagacttgttttggatagccgggggctattgtttgctattgtttcattgttaaatgtcaatagattactcagtgataatagatccgaggagatgaacatggctgcatgaatattgcaagaggcctgtgtctctcttggggaccctctagacctatttttgaaagtgactcattaagtctttttgcagagttgagttcacattctcagacaaggtttcttaattttcttagttttggaagagaggaaacacaggaatggcactggctgaaacacaggaatggcactggctggctggatagactgatgaaaagagggaagcatcctacctgcctggagagctctgagatcagaggactgagcctgggtcatggaagggatgatgtgtttgcacgacagtgctcagaactgctaacaagtaccaggggacatggtgttctgcattatctatggctggcttaccagcaggctggagtctggcagagtgtctagattcttccaaaggctagagtctcagaacaagaagataatttcccccaaacattatggtagttgagtgtactaaggcctcctaagaatcacaacttgctatagggtcatgttggttttgtgtcctttggcttttcctcatctctatgtgagttgatctcatgaaaatgagttgtttttttttttttttcccctagcatcaccaccaagaaaactctcaatgtatctcaggagtaaatgtaaccatgacttacattttttttttttacaaccacttgaataaaatcttccagaagcctcttcttggtggtttctggagttattttcagtcattcagaatcttggttcacgtgacatgttaactagatagatagagcagggacagctaagaagctgtggttgaagggagggagggtgaagcccagcctgctggactaatgtcccacccccacaggccgcccccatcagctgagtcagcccttgagtcaccaatgagcaatcccttcatccccagagcgtcatcacactgagtcctgacaatcgtcaggtatgactctgagagcctcacagtgactctgtgagcatgctaatgaggctatctgtccctggcatgaaggagacagacgaggaggagagaatagcgccagtgctgttgaatccagttcaagaaaatgctgtaatgacaggaatgcagggaaagggacttgtggaagatcaccaacgcaggagggtttggaatcttgagtagggtcatttcaagactcgtaatatactcgttagctcagagtatatttcttttgtatatgtgtatgtgccaatgtgtgtacaccttcatgtgtgtatgggacaaaggacaacctcagctcatactcctcagatgctgtccaacttatttttgagaaagagtctctgactcatctgtcattttccatgtaggcaagaaagtaagttctagggatctgcctgtctctgtatccctagagttgagattagtactgcaagctactatgcccagcttcaaacaaacaagcaaacagaacaaaaacatgtgtattctggagtaattgaactgaggtccccatgcctgcaaggcaagagcttcgctgtgtgatctatctctaccaccctggtgcattaatagaaactgacttgacttctgggtaggtttctggggggttaaaattagaattagcaagcactgactgctagatgggctctcttgagcatatgtgagcttccttcttggactgtgtgctaaaggtgtgcgtgagagtttccagcctatcctaaatgctcttgcttagcttcaagtacctctccgtccctatccagcccagcttcaaggcttaaggtccatctaatcattcaaccactctcaccatgactagaggtatcagctgcaggcatcatagagcagatgcatttgtttctttgacaaagatgaatagttgtcttttgcagcctcattcattcttgtgtctattacatgttttattctgggtgcctttgttttcaggcctgagtgatgggcagatacaatgtatgactcacttgaaaattaaacctcctaaaaattagcagtagccaattttcccagatgttgatcttaggccctgcaagttgaaaagactaccttctcatctcagagatggtggctgctgtgctccattgtggccttaatctgaactgaaaccagggaaccaaagctgagtcttccttgtaaccttggctaaaaatttctctattgttccctaatgtgaaagaactgtggatcatattcttatggggaaaaaggacgaggagaaaagggactatttcattttctagccctagctttcctgtgaactcacctacaggtttgaatgcaacatgctggctcccagcatatttaggtataccataagaatggtccttacatcatcctatgcccacatgggtagataaggagtgttggttcaatgtgactgctgatacgagataccacaggctgggcaacttatgaacaagagaaacttattccagatctgaaggtgctgggagtccaaggtcaaggttctggaagcttccatttctggtaaggcctttatttctgattcttagatgataacttattttgtcagggtgaaggagggcaaagtaggcctttagagccccatctcattcacagggactctgtacctttggccccattgcttctacaaaaccttgtctcctaatgcagtcacatgggtgatgagatgctagtatctaagctggaggcacaccattcagaccatagatgagagcatctcaggactgcattaggaagtgattgcagagtgaaggagctcattttctaaggccaataccatcttaatgttttgaaaagatttccggttttagtatttagcttcaataaatttagcctcagattttagatttgctgagaggcaaggaaagtatgggcaagtattgtctagaatcctaccgctgttttgaatacagccagcattgcagagatgtgctccaaagaatagtggcagcccatccacagaacagaatgctaacttgtctatctgtggccattcctgggagtacttgggaagtttgataactgatggatttggccctggtttgtcagatccctactggaatattcagtatgttcttctgtatactcatctgctaagggtatcagaactacatttcaggagcatgctggcgtaagagatatgaaagcgtcatttctcacaggcgagtacccatcgtcccaactagatgctatacttgcattcaaaggcctattaacctggctcttacccagcttgccagatctgtgtcagcctgagtttcctggccctctgcctttccaggacctcttggaattctgtttagcatgtggccagcagacaggcacacttgtattggtctggcccatagacagaaggcaatggctacgtattcctcctgtttctcttgtcttacctgtgtttagtacttctaagaagtgatgacaggtgtttctgtatagagtaaagggacatgctatttctaaaatcatactgaagggtatgctgctcccctcaaagtacatagaaggctacaaaccacatccttgtgattttttttccatttgcattcatgttttgaaggtcccacaagttccagaggtttgtttgtttcctgtttgttccagtggttcctagtaaaactgcaaggtatgtgcagacatgtgcctacctgggctgatctgtaaacaagcctgtaagttttcaggatcttgtggccttgcacaagtaacccagtcatcacatgtctcggcttcttcatctctaaaaggggccactaaaatgcatctatattatatcatcatgaggaaagatgttttaatcatactcggtggtgtagtttcggaactgaaataacttctctgtgcgctggctggttttgatagcagtatcaccgggtatcatttgttgaaagctcttagcagcctgccaggcatgtttactgacttcccctcaagaagtggacgaaggttcccaaagcagcatggttcactcagtctctcaatagtgttacattactgttccaactcctcaatttccagaggtgggaggggaggcatacctgagcagcagaggcaacagctggactcacacatcatcacatttagaactcagccccaggatgctggctcagagcccaaggtcctgaatcttctttgcagagctgtcagtgaagcagctcctgacactgggacccaaagactgaatcctaaccgcagctctggtaggaggttcctccaacattctttctcctactgtaggtcagggaggcctgagttcaaatcccaatctacttccctagcttcccaatcctgtgcctttgtacagatcattatctcttctgaacttcagtttgttgtgaaatatgagcaacaatatccatttactgtagcccctggccagataatgctgcaatatattccaggttcaagtaaaaggcctcacatttatttagtgcatggcaagtgtcagaaacaacgacagtttgttacgtttatctgggggtagtttccatctacgatctcatgtgatccttacaccagcaccagatgggcactcttgatttttcagagggagaaataggctctgtgagaataagtggctcattcaaggtcagaaagcctacaatgtggttgtggcattgagactcaaaccctggcaggggtgacctatagaaatacctttgtgtattactcctctttacagttccatgctaaggtccttgtagtatgcatacatcaccactttccatgagcagcagcgcccttgtgatggacattttcatcatatctatgccgggtgatgctttcatttgagcctgaggctaaccttcctcttccaagagaatacagcacacatctagttctggattttttaggggtgttaactctgtcacagatggtttcccatgtctttggacacagttggctgggtctgttcctctatttaacagtcaaggtgattagaagagacatttttgcaagagactgtaaggaggcatcccaccattctccagttgagtggagggttcccatccgattgcaggagagatgagtgtagcaggatacaagcaaacctcatctgaattctccagagaattctagttaaccattaccaaatgagatgcccttcagactgggggacaagaacacaacaaatgaccggaagtacagctgcaaggcactttaataagaagggagggaaggagagtccaagattagtaaccaacatgcttctctcatctaaattgactttcagagtgaagggtaagagctgagggggaattgatttggatgtgctaagtagccggcatggttttgtttcacggtggtgcaagcacacttgactcttgcatgactgctctggaagttgctcagtggagcagcatcacctggagctgccctgagtctgtgaagtaacagattcaataagaaaagctggttagcactctactgttctacagcttccactgtttttcctttgcacccccactttgcctttcttgccccagtgtcatagaaaacatccctgccctgggagattgtagcgtacatctgatgtcggcagtccaggaacgtgcccagtgggtccacaggtgtgtctgtgtatggagtcagatgtcaccaggaagtcatggaggaggaggtggttgaaaaagtagaaccaagtaggggatggggataccttatccattcactgggaattatttactgaatgctgactgtgtggcacatgttgtttaagctgtgaatatagagctgccttcagtgagtccaagtcagagcaatgacagttgggaacagagcattgcagagcagggtatttaagtaccaatgacctgcgatgatatctcacttaacacccccttggcttatctccattctactggccaagtagaaagaagactttgttctttgcctctcttccattctatgacctatcatcggttctttgggaaatttggtttgcctttgtctgttgggctgaggggtagacactggcatgaagcctctgattcatgttgttactgggattcagtttcttggtggaaagaagctaagccagatgacctagacccactaagtcagaaactcctccttcagagtcttcggtttggcctttctcatgaagattctaatgcatagtttgaagtcatggaggcagagttggaaagtgatgtatggctctgagtgctcacctttcaacaggtcctactgtgggcatggctgatgggatagggtgcggtcctattgtaaaagtttggggtcatgtcctaaatccccagaagcaaaacaagaacccacaaacatccattgtcactcatcaatttcctcagtcaacacttacttcctaaatacagaagtcagaacagtaggattctagaatcaggttatctggtttcaaatcctgccagtgttatttactatctgtgcatctttgagcaaggtccttaattagactctgcacttcggtttcctcatatgtaaagtggaaatattagctgccataaagggaggttgctgtgaggactcatgcagattgggaggcacgtgagctgactttcagtgtcttttgcccactgactcctttacgtcatcagttcattggctgccattggtctggtgtggggctgggagtgaggggtggtatgttggtactttgtgtttactcatccaatgttctcagtacaagagccaggtctccccaaagcatatgaatcagtatgtaaagttaagtcaataacaagtgctttgacagtgacaaaggatggtaggaaataagtgactgtgggtgaggaccagtactctgtagagaggatgaagggagggggcagttctgttggaaaatgagaaatgaacaagtcattggaatttaccaatgtacagtggaaaaaggaagaaagagaggaagaggaagaggaagaggaggagaaggaaggcagggtggtcagagagagagagagagagacagagacccagtcagggagagaccgactccttggatttccaggaaagagatgagcagttaaataaaaattgatcctgaggccaaataaacttcaagataattgcttctactggtagtgaatcattatgtctcacaaatgaattcatctttgtaagttttcaggaccaaatgtccttgatatatttattaatcctcttcacttctcttccttcacctgatccgctcacctctgaattgaattgaaattaagggtcattagtttggaagagttccctgttagtaggtggctgactttctactcagcctggctcggttcctctcctaggaaaggaaagttcaccgtctctgctgtctccattattgtgccttttggatttgtgctcaaagcagtgaggctcacagaatgatccagttttcctgaatatgtcccatttccaacctttagacaggatgtgggaaccccagagacatgcatcagtctgagatgatgatgggatctctgtgtagggtgctctggtgtttagattgtacaaggtagcagagcttccttcctttgtatctttaaggatcttgattctgacctcatcactctcttctcctataggtctctctctctctctctctctctctctctctatatatatatatatatatatatatatatatataatcagaagtctttgaacgaaaaaatttagtcttaaccaggtttgctcctgaacagttttcaaattatttttccacttttaaaaataactttcatacccttttcctgccatggtgcctcttgcttcagttttgttttctggaacatatttgcaattttttgaaaatgtctttttggtagctttatgcatgatctatgttccacccagtatcctcagtttctagaacagtatctggcaagaaagatattgaggaaaataggaaaagaaagtgattggggctgggaccatagctcagatggcagagtgcttgcctaccatgaatacagccctagattcagtcctcaaaagcacataagctgggcaaggtggcacaagcctgaaatccttacactaagaggtagagtcaggaggatcaggagctcaaagccatcttcagctacataggaagtgtttgaataatcagggctttccaagaccttgttacactgccccccttgccccctccccatactacacacacacacacacacacacacacacacacacacacacacacacaaacagaagcacataggggatgaatgccattggctagcaagacacttggctcctcccattccttcctccatgctccaaggtacagttgtgtcatctcatctaggcaggataattggaaggactacttaagaagatgaactgtaaaatcaggttcaaatagaacttactacctgtgtgacctcagaaaaataaatctctttacattttataattctcagtaaggtgcctagtttatgataagagtgcagtatcgccaggtgtggtggctcacgcctttaattccagcactcgggaggcagaggcaggcagatttctgagttcgaggccagcctggtctacaaagtgagttccaggacagccagggctatacagagaaactctgtctcaaaaaccaaaaaaacaaaacaaaacaaaacaaaataaaacaaaacaaagagagtgcagttactaacttctgagaaagaaagcctatcccttgtttgggtcatccatgacctcaggatctggacttactactcagctaaagtagcctggggattatatggaatataccaggctttgtatgtagggtcaggaatcataaagcactgagcctagaggagaggccgtaaagacagtggccaggctatgtggaaacaaggtctttctttgaggtacaagttttccgaggcctgaggaggccctgtccctcaggcttctgtccttcccatagccttttggcaagattttcataagtgtattaaaaaccaagatgggctgaccagatgagtgacacttgccagtgatggggcattgctgtgctcctccaagcacggagaactcgttcaattatgttccacccctgtgatggtgcaatcacaggcacacacattaacttctgattatagccttgttgttgagtctcttttgacaggagggaaatgaatttacctcatgtcacctctgtagtttgcaagcagccttggcctctgataagagcagcttttatggtttatttatttattttttttaatttttttttcctgagaaaaaacattcgggtggtggcatacacatcgaggcctggaggtgaacttgaactgactcttcatagtgatagcagcctgtacaggctcaaagaaaatgaccagtggtgttgagctgaccctgaaagggcaaaggccatgactgctatgcagaagagagtcctggggttacacacttcccatcttagatcataacagtactagattgtgcatcccttggcccttctacccattcatagaacaggagtactactaatagttaccctacaggcacagaagaattagtgagctattatatgcaaaatacttagcacagcgactagaatactaattgctatgtattttgataattagtaaaattttttctgacaacaatgttactgttttgaggaaagggggagacaccagagttcaatagtatcttctccatttaatagctgtgtgacattgaacatatcccatcatccctgtggactttttgtgacgtgagaggagagaggactaaagcttagggtacctgtgaggatctcagtgacacagcccactgagtgttcagggaagcttggtccacaaagaggttgcttgattattagccattttcttttattgggatgctgcctctctcgtatggcaggaacttagagaggggaggagtatccatgatttgagtctcggccttgaggtaaaagccttgctttccatctggacagcaggcaagatggataccttctaaacacaacacaatggcatttggtaaagtaccctggaaaaggctaggaggtaggtaggtcctgggcatcctgcaacttttacctgtgcatttagcacttgctatgagtcctgttgggaagggccacagctgtaagagaccagtagatctctttctgacttcctcctttccactaggacctcctctctccaccacaggatgtgaccttgccctctctggtccccattactgtcatgccagacctgtgcaggtctgggcacatctgagtcttgacatttcactcaggcagggctttcttagagtcgacaggattctgtgatgcctctctggaaactaagccaatagtctctacagagaaaatggtaaagcataggacttgctacttgtctaatgctgttttatttttaaagtcaacttattccctgcccatagttaattctcagtggcagtacgagtggcagtatgctaagaccctcagcacagagggacagtgaggtgctgaaaggccctggcactttgatctgatttcagatttagaggctgagtcaggcacaagctccaggacctgtctgccctttggaaaccttcaagggcatgacatattttggaagaatgtcccacactcactgtgagtaccttgagggttgaagttaaaggttgaagtggcctctgactcacagccatagaacctagtggctatagcaagagcccttgtttccaaagagggcagggcctgctgtttctggggatttggtactgtgctctaagggaattgctttgtgcctccacaatgagtctcaatagggatgaggcaggatggtgaaaggggcagacagaagcacacatgagagataaaaaacagaaagggagaagagaagagctagagaggtcagggaactggaaagcttttaggaaaacaaacaaacaaacgggaaatagaaaaggcaaactcaagacacagatttgtaaagggaaattaaagagccatcatgaccactaataagtacaaaggctggaggatgacattgatttcgtcatcaaccctggacttgtcattaatgtttgcaatactcctatggcgaaagtattacggtcaacttcacgttgtagtaaaaaaaatgatgtatatttagaaaagcaaagtttacataaggtcatgcagctttgtaggaagtcaggctagaacctgggtccatttgatgctatactcagcccattgcaaaggggcattgatcctggggcctgaagtttggcaaactatctatgggccacatataccctagatactgagagacacaagcagtctctatgcctctcactcatgaattcagtgttagttaagagacttttagctacaattaagggagaacattttttccctcacaaggagaaggcagagctgctacgctagcatgttaaaggtggcatctctagatcttctcaactctttgagagataggcagcttcacaacgttttagaggtggaaacaagaggggaagggcaatatcagaccaagctattttgtcttccttgtctctcatacttctggacaaatctatgtatgaccttccatatttctagctgcaagagaggctgccatgtgattattgagtcttcaagtctttaggaaggacagctttgttgtggtatctccaacccaaataagccctggcaatgaaaacaggactcaattaatatgaatacatgctgtgcacctagattgggcagatctactgctacactaccatcttccccatctatgagaccccttagaactttctccgagccatgtgcttctgctctgcttttcttcttcttcctcttcttcctcctcctctctgtcctcttcctcttccattttctccttcttctttctcctcaccttcagctccaccttcacttttatctgcccaaccatcagctctcttttattttacaaattaaggtgggaagcaggtttacaggaaatcacctgagtgctaactcattccttgttcgaagccactcacacgagtacggaattaacatctaatataattagccccagggctatccacaacacaacttgggaatcctacagaggaggcagactgtagtgtctactatattccaacaaatcattgtaggcccagactcacttctaacccttacttgaaggagaagcaattaattcttttggtaattacaggtatttcttgaccattctgagttgacctggtatgagaatatgggggaggcagtatactcactaccatcctggtgttgctggaaatgatatgaactagttccacatgtcatgtcttgaaaatcaagaccagtctgttagctcctgagtgcttattttccctatagccacctgcatatatcagcaaagacagagtctgacaagggtatagaggagggaaatatgtctaattaacagatttttctgaaatattttactgatttggaatacaattgagagaagagatgtaaggaatggcaataagagactcagatgaagaggcccagaaagactagctgtgtttggattggtgatatctttagaccagtgtctttcagctcgtttcattatggcccacatatggggtcttggtaaacacatttttcctctaaccatgctccctactgacatttcaatatcacaagtgcattaagtattgcactccttttatgcagaatctagcatgctgtgtgtctgtacttgtacataaaaggtatgaaatgtgttttccagtttagaggagacattgctcctatgtagaacgagtcagggacaaagggtcattttgcctggggagggaagagctggatctatcctttaagtttggagggttgtcacatattttgagtacctactatgtgccaggtacatagataggaacttcacatgcatcacctcattttctgtatcagacctgggccctctgtcacaatggaggccatcaaggtttgagaatacacttttctgaaagagacctgctttttctggaacaaggaacatacattgtttttattatgggccatattcagggcacgtggtatgggatgcgtcagggtgaagttcacagtggtactcctggtgggaggagaactggttctgaaggagaggcagcccaagtaagaagcatgacagaggcagaggctgtgtggctggaggggactttggatgataaagatgactctcactgcagagctgagagacactgcaggctagttgattagggttccatttctaaggtgttgttgagctaaagatacaggctgagttaactaaacatcatttctatcaggcacaaaggcattctaaacaggtttgaacaggagacagagacacaaaaggtaggaatctatggtctccaacacagggagtccatttttggagtggaatggagacaagttttggagcaaagtgcagtctgtgaccaaaaggagatagaattcttgtttggttttccttcctgaggctcttctggattgtttgccatcccttacagacattttgctgcagctcttactgatgtgcccagagcaacaaggatgcactccagtaggaaaagaacccccaacctcggtagtcattacaacgaagctctatttcctgctcttgcttcacacactgctcaggatatatgggaactagggcatctggactctacatttcctatctctaaagccttcattttaacatgtgtctccattaccgctgaagtaggggaagaaagcatgaagaatggttcacagctaaagtgtgacacatgccacatctgtttgaattgccaacctggaacaacctaaagtaaattgggaagaagggaacctcaactgaaaaaaaaaatgtctcaatcagattggcctatgggccacatctatgaaagattgtcttgatgatgactgaggagggagtgcctagctcactgtgggtggtaccatccctaggcaggtaagactaggctatataagaaagctaagagcatgagttgttgagtaagtcattaggctgccttcttccttggattctgctctgggtttgttccttgaattcctgccccaacttctatcagtgatgaattattacctggaaatataagctgaaataaaccctttcctccactaagttgattttagtcgtgttttttaccacagcaatataatcgaacacacatcattggcctagataggttacatgattgaacctaatatcaaagggagcagggaaatatagccttcctgtgttcggaatgtgaagagtggaaagtgcttgctagcaacactgagagtgacagtgacaatggtgatgagtgaagacagcaaatcaatttctgaagattcacttgcaattatttttttctcttgcctttctctctgaaatactccaatgatttcaccatttgtaccttatcatactgtctggtaaatacttattggttggctccaactgaagttaacacccctactgcaaggagtattttggataggagaatggcagctatttattagagtcccagtccttatatgctagccagactgtcagatatatggaacaaaagccaagcttcccaaggtggtaggtctaggaaagtgaccaatgacttgcctcagggttgtgaaacatcctgtgaagacactatcttatcattgagtcgtttaaatgcttgttaactggccctctgaattagaaaagcaagtggagaagcttgtagaaggagatagcttgttaatcagtgatgtaacagaagtatggcctagcataggtagtgtgtatatgatatattcttgcccaatatggagcttaaatgatctctttcctactaatttccagaaaggcctgttcctgttctatagataggaagaagcagtctcagagtggcctctcccagccagatcttcttagtaattcatgaaaaagcaaccaatatctactctgggtgcatctgctgagatgaacctggacatccagccttttcatcaccaagctctgaacactctccatcaagtgtcttcagattggtggagcttaaaaaatgacagccatttgaaatcgagtagaattgggtattattagaatagcattctaaattctaatcttttgcattgacttttttttaatagcttctactttcactaaaatttctgggccaggctcacagacattcaatttaaatactgtcaggcaagactgatttctgttccaatagagccagattttctttctttcctttgaaaaagaaaaaaaaatagcctgagactttttaaaaaaataagttgccacatataaagagcatatctttccataaaccatccttttaattctctatctcctaccctctagccttctttccagctttcattgatgagtaagccaggtgatgactgttgttgtctaaggtacctgtattatcactacattgttgtcatggtgccagacaaggccagctttgctatacctccttccacgtgctctttcaataaaaagatcccttgccaaggctcccaggaagtatttaagaaagatgcttttctgtctatcctcagcctgttactgcttcttgtcagctctcttccacatcctttcagccagtttgtcttcactgtttcacttccactctggtttctgacgtggagctaaggttgggataatggagatggagagtaccagtggattttgggactcaaacttgacatagtctgagtttcttgtttttccagttgtaaactttatttagcctatgagaacactgactttaacacctatacaccaagtttagctgtgtctttcccactgcttaatcactgatactatgggaactggggttgaggtgtgatacttggcactgcagttaatggcatctagagctgagagactatcctttttctttctctgccccagacttcttggcatagcctaacagctctcagtcttagatacacattagcatcatctagggagcctttgagaggctcaaatccttgctagcccaatgaaatctcaatctgagagtgtatgcctgtggcatctttactctcaaaattctcttcaggtgaatcagatgcatgcaagggttgagaacaactctaagtccctggggttgcccggggcctgaatatactttccttttgagatcagaagaattctattttattgcttgtgggcacaggtccagatttctcatcagtgctgggacagggttttatttttcctagatacctaagagaatgtagagaagaaattggggtggaaaagatacttggtgggttggaccaagcatcacttgagatctctgcatcatcacatccaacttgagggcttgtgctctatctgtatgtctgtgtctgcatttgtgtctctgactctgtgtctgtctgtctgcctgttgtgtcagatgccttcctctgttactttccaccttcattcttgaggcaatgattgttcctgaaaacaaagtttggaaattgtctataccagctggcttgaaagccccatgggccctcctatctcatactcccagctatggaattacaggtactttgctttttatgtgggtcccactttcttgtgcaacaagcacgttatctattgagccatctgccccacctcacaggtttattgttaaatgagtcttgaatctccttgcattagtttggatttttagaagttagaatcaggctgtattaaatggctttcttctgagcctgctgattttcttcttttacattttctgtttctcttctttcagccctccttacttccttgctgtcacacccatggacatgggcaaatgagctctgctcgtctgttcgtcaagcctcccagctcctccagccccccctgtgccccacgcctgagagggtgggtaggcagatggcaaaacttcccattctgccacttagggacacaggtgacaccaactaatgtcacagcaacaggtggggaggaggtttcagagctgagctagcaagggacatcaaattctcagtgcctcctgggcagaatacctcacctggcaccatgctgttggcagaaggtgcagcagctggctctgcctcagcttttggccaagccaaggataatgttgggtgagggtgggagctgttgcattgagggcagatttagattgtttcacatcccttagcttggtgacaaatggggtttggcccattggcttctctgatgcatgacaactcatgtcctcttccctctcctccttactgaactctcaaatctcatcttcagatcccacatttagggaaagtgctcctcgtaggctcttttgcagctccagctacctagctcacgacagttttataaccgtctctataatctttctgccacattgagctcttcttccttgacagcagagcccatttctcatcatgggtatatgatcttggagaatgcctggtactgtcagtatttgtagatgtgagtgaatctcatcttagtggacagcaccatttaattaattgtagatctatcttgcttatctattgaatgaaagacactggcagttagggtaagccaaatgatcacacaatctgaaacatatttctttaaggcctcaaagcactatccaggggaatctgagagagggcacagtttatctgtcttttcactcctatttgctaagtaaaaatgagaattaaggtgctatgagcatcaataattatgaaatgcctttcactgcctccctcttcagtatcacttcatctacataggttctatctagccaaggcagggatggttgtttatggaaatggacatattacttatggaaatcgacatgtctcattgacccactattgccaagataccatatatcaaggagcagtgttgtatagatcagacataaaggtgagtgggttattgcttgttattatgaactccattcctcatgctcagacttcttgccagtcaggtttagaggtctgggaaagtgccaaaggggttgatccaggccagcatgggattaaaagtcctccagggaaatcacatgtgctaagtgagctctctgaggttccggcgcaaggttgtgctggtcaaggacagcaagtcgcagggagtctgggtgaagccagtgtgtgttgctgcctcccttagtttagattccatgtgacatagtatattgaagagagaatgggactgactgagctgacaatagggctgatggtgccagcatcctcctccatctttgtgctacattgctgttcactctcaagaatcctgagataaaggatattccagatgaaaggtgtgggacccaagtcctccttgttagagtcattttcccaaagtcatgaagatagcaggtggcaggattgagatttggtgacattcttggcattcgccttgcccactgacccctactgccttaagagccagctgcctatcacagacttgacattagctgttggctgtgtgagttttaagtcacaacagttcccacagatacattttctgtaaaatagggatatttctggcttcttgctgttgaaggaggcttagaagactgaaggaagaaaggtgatcagcgaggtctaggaaagcttaggataagaaggccatttgcacttgctgactcctaagagtttttgggtcctggctgacagcccacatttgtcaaaggtgtctccagccctagctctagcatggtaatccattcaactttgagagctctgaatctcctgtaatccacagaggctgacagagggatggtgaggcagctggaggggggaggtgagtctgtccaaggaagatttagaactactctgatatgatatagatggaagtcacagggcatgccacagtttttagaggcattgtggcctgtgtgatatctactttcacccatttgaagaaatgctgagttcttttccatttttcttgactgagttggtgtgtaaacaaagtttccacagcttttgcttttgagaagagagtgggaggagctaaatattagaaagaaggagaaaggaggccatccaggtgcactagggaaggagggaaaccagtttctttgttaatcctgacttggggcaataaagacagctagtgtcaggcaacttctgtatgtttgtgggaggaagctccaggacctctgcagaggcccatatcccctcatgttaaaatccctttattagttagggttctcaaaaatttattgtgatgacttacagtctgtagtccaaaacacctaacaatggtcagctgtgaatggaaagtcccaagaatctagtagttgctcagtaccacaaggctaattgtttcagctggtcttttgtagaagtaggtaccaacagatgtgctggcaagtaaatgcaagcaggtaaagaagaatgaatctttcttcttccaatgtccttatgaaggcctccagcagaaggtgtgtcccagattaaaggtgtgtaccaccacaccaggagctgggacttgctttggcccaggctgaccttgaactcagagaacccttgcctttgtctcctgggattaaaggcatgtactgccttccccaggcctaagtttttcagggccattatgcctcaagatctccatgtcaagatataggtcagaaacttgtgtctttcagcctcaagatctggatcacaggtgagccctctaattctggattgtagttcattccagatatagtcaagttgacagccagaaatagccattacattccccaacttgcttcttggtcatggttttgttcaggaatacaaaccctgattaagaaaaactagtacttggagtggggtattcctttgacaacctgaccatgttttggggaggcctatggaaggaactttagagctctgtaggatgttctgtaggagcttggaagatcatgttgagaacattgcaaacaatgaaggcctggcttgtgaactttcagagggaagattaaagactgtaatcagggctattgctgttttgaatgtgaaggtttgggttagctgttgttgaagaatcagctgtgattaacaagataccataagtacttaagctaaacatttgcattactggggcaattgatactggttagctagagttaagaaattagcagtggttaagaagagactagcatcactaaggtgaaatcttctgggaagtgtttcctgagagtacagagaagctgtgttccagaggcagccatggctgtacctcatgttggcagccagacttgtcttgtataagagtcacccaggtgatattggttttgaaacatgaagggttagcagctgattcttggcactgtgagagaccagaagaggccattggtgaaggtgcagccttagtggcaggtgaaggcccagaactgaaggagtcatgcagagatgttgaggcttagcaccatgaaaagagcctttgaaaggctattgtgaaagtgcagtccagttacagcggaagacagcagtgttttggtgatgccagtaccatgagatgaccaccaaggacagcagcagcagtggagtacaggcagctggagcctagaagacaacgtctgtgctacaaagggcaaagctggagaagtgacccaagcccttggaggagcccagaagattgtgagtggatcccagacactggacagttagagtttgattttgcttttgattgtgactgtttgcccagctatttttccttcttgaagtgaaaaagtattttagtggagcccacagttaagagactttgaattgtaaaaagactttgaatttcaaaagagattggctattttaaagggattgaaattttaatatgtaaaaatttgtaaagactgtgggacttttaaagttatttagatcttggggatgaataagaaagtaagggttgaggcttaatagtgatgtgtttatgtgttaagttgacaagggatcagtagtaatgactggttttgtgtgtgtcaacttgacacaagctggaggtatcacagagaaaggagcctcccttgaggaaatgcctccatgagatccagctgtaaggcattttctcaattagtggtcaagggtgggagggcccaatgtaggtggtgctatccctgggctgctggccctgggttctataagaaagtacactgagcaacctaggggaggcaatccagtaagcagcacctttcttggcctctgcatcacctccttcctccaggttcctaccctgtgatgagttccagtcttgacttcctttggagatgaacaacaatgtggaagtgtaagctgaataaaccctttcctccccaacttgcttcttggtcatgatgttttgtacaagaagacaaaccctgatgaagacaggaagggaaggatttattcagcttacacttatataaaataacatgttttgtacagtacctatacacatctttctctgtgacttatagtatttgagataatgtaagcactttgtaaaacttgtgatgctgtactatttatgaagtatgtaagaaaagtgtctgtatgtgtttattacaaacacatctgcaactgctctttcatattttttcctgtggttttgttctatagttcctaaaactgcagatatagaagcttggatatggaggcatgattaataataatcattatcatcataaatgtccctactcagggttacactatgtggcagtactttctgttaatctgttgtgtgactgtgtgtgtgtgtgtgtgtgtgtgtttaattgttcatgtgaacatgcatcagtgtgtacatgtgtaggtcagaggactattctcttcttccattatgtgtagaagtaggttctcttcttccattattgagtcctggggatcaaacacaggtttgtcagtcatacaccttctctcatgagccatctccttgggccaaaggtacattatcttatttgatgtgttaaaaaaactacataagtagaatattaattttttttactattgttgcataggaatgcatttgagcaaaaaagaggtgaaggaacttgcccacagtcatattcttattagtgacagaaccaggattagatgtgagatgttagggttacaatcctagagtctcacttttagtagacaatctctgccatttctttgcagtgaattagagaacaaactcagagtatgagatagatgtgtggtttattatatgagtcagcagaaggaaattgtcttaagtccatttgatctactataacaaaaactctatagactggacaatggtaaacaacaaatatttacttcttgtggtttggaaatctgggaaaccaaagaccatggtgcagacaaaattaatgcctggtgagggccgaatgccttcttgttatgtcttctttgccatgtcttatataaggtcactaagtccatccatgaggctacctccttgtgacccagacattttccttaggtcctacttcctaatatcactgtacttggccttagaattgtacctatgaattgggtgaggtgaatgcattctgtccatgcaagaaccagtgttttcccaagtgatccatgttagctccatgaaccattataaagtgtgtgtgtgtgtaatacagtttgacttaaaagcacaatagtaagggattggaaacccaattcctaattcaaactatgtctgttaccaatatctgtttgaacaaatctttctttttttcctcctttgcaatctctagaactcaggagttctgatttctatttaagtctagaaatgtatccatttctccttaacttttttattaaatttttatcaatgaattctacatctggttgcaaatattaaatgaaataggattaaaaaaaaaaaaaaaagactcacttgcccaccagcctttggctgctgttttctttcaggaccacggacagggcctagggtggtaagcttgagatttttgttccatttatatttcttggcatttttctaagcgtataggacaccacaatacccttctgtgctgaaatcagaatgtatgctaccttaagtcatttctgaagataatatgcagagtgagcaactgccctacttcctgcagcccttgttgggagttaaccatcaagaacaccatatctacctttaccattattacttccacaaacaccactgtcattaccacattattgccaatggagctctccatcatcaacactatgtatactaccccccccacacacacactgacatgagcaccatcaccaccaccaactccagtacttaccatcacaatcaccattgctaagataatttcaccattaattatcaccattatcacgagtgccaactccgtcaccataactctccaataccatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacttgccaggctctatgttgtatgctttatttctaccatgtcttaaaatgtattgccaacttattatttgttttatttttatataccagtctcaaggacctctagtatgaagttctaatttgggatgcagataattgggcacaatagaagcttagaaaaggcagaatagtataaatgttttgtgggcactgcaaatgtggtagtaaaatagcattagtcagccagcaacaattagggccatggaaatagaaaggatggtgaggatagccatacataaagagctttctgaaggaaggctgactttcagatttgcgaactgtgtgaatgagtgaatggttgatcttgacatcactgctaagcagtctcttccaggttctgagcatgtggttaacaggcagctctattctcagtactggaggagacccccaaatcaaatagccatcctcctacatgataaggactggattcaggtcaacctcagagaagcttttgagatcatagaatgaggtcaacttcaatacacagtgccaaaggtttggcttcatttaaaaagccagaggaagccataataggattgtgagttagagacttacctggctggatcacttatttaggtgaaactgctggtgctgttgaaaatgggatggagataagaaaacccatagaaaaactgcagagatggcatgagagtatgtgctgctcttgccaaggacccagatttggttcctgatatcctcatgatgtctcacaaccgtgtgtaattccagttcttggggatctgatgccctcttctggccaaacacttcgtcatataaaataaaaatgaatcataaaaaagacatttggaggggctggaaagatggtccagcagttaagagcactggctgttcttccagaggtcccaagtttaattcccagcaatcacaaccatatataatagtatccaatgtcctcttctggcacacagatgtgcatacagagagagtactcatatacataaaataaataaataaatatttttaaaaaagacatcggaggcagggcaggcatgcagaacaaatcacagccaaggcagcatcaggatcaatgcagagatgaggcagaagggagtgaagggctccagtaggtgttcatggctagttcatttggaggcagttgatagctggcctggtataccatcattctttccattcctgcttattcttttcatgggatcagggactggagacttattaatgctattctttggcttggttatgtgcccaagatcaaagctcccaaaaaccagatctcatgactgccaaaggctatttctgcatttggagcagttctgtttgcgttaacttcccagccatcactattctcctcaattccctgtgctgaggttaggcactgctgaatggcagggtacccttcctgtggaggggaagaaggggagagattcagcagactccaagaaaaatattaacttgacatttagcgaaagggtaaactggtttattgcactgcaacagagatgtttgcattctgagttgcctcctgttttcatcctcttggtggtctggctaggatgtggtcttgactatgtaaatcaatgtggtaatgacataaggcagctatttagttcgaagtcgattcccaaccccaccccggcctcctaccacccacacccagcgaccccaaggttttaatgattgctgagagtcactttctgacattttcttccctgatatttctaaagttgtaacccaacacaaccaatgtgtacaactggacatgcatgttgtaataggacaccttgggttcctttgctgcctccaccctgtcctggatttccagctaccaacagtaaccacctgtgggcaggaaggagcactgaaggaacagtgcatcaggagtaaggggaaatagaacaaagtgtctcccagagctgtgtaaggctttatctttaaagggcctctgttcctttattatctcacagtgatactgaaatgaaccaggcaggtccttctctatggaagaaagcaaagccttaggctcttggataccaataatgtgccaggcttgatacaactctataaaccttcttccagagagttagttcactttgtcactaacagaaaagttcaaatcccagcaatcatagttcccaagtaagactgctttcttctttgttgagccacggtagtctcaggatagagaataactcctatgttggtgggaaccttgtggtctattgagacgatggaatggatcagtctctaatgagtcttcaagaagtctatagtaatgccaaagctacactcttcctgtttacctcctgggtggggtgggtatgtatgtgggagcaggcatatgcatccatacatgtgtgtacagaagccagatgccaatgtcaaataccttcccctataactcttcattttgagcccctctctcactaaatcattaccaatttggctagactggctgctcagagcatcatgaacctattttctctgcccgtatctctagcatcgtgcttttagatgttcactcactcctgtctctggcttttatgtgggtgccagcggcactcaggcccttgtactggggcagcaggctctttaaacacagcataatcttcctatccccgacatgaggtttttttttttcattctttctttcttttttcttttttttttaaaaaagggacatgtatgtattggaatagagttgaccttacttgatctgcattcacactttaatatcattgttgatcctcagggaaaaaccttttcaaccttttcacattatggaattcttgtgctagtgaggaccttagatattgctatagtacaaaggctacaaaatggctgaacatcggaatgccctggggggggggttgccagcctggactgactaaatgtaaatgtgtagagttgatagtttatttttaactgtcactcttccttctagtgtttgggaacagtgatctggcttatcttccagctcccaggcaggatgttcacagtgagatttccccagtagggatactcttggccggccctcacacccttccttctgtttctaaggaacatggctcttgcccacttgaggtaaccgtatatgatttctcttctctttttaaagcacaaagggtagttcctgttggcaaagggaagagcagaaacgttcagcttctgatacatctgtgcacacatctgtgttcggcactccctcaccacctctagtaattatctgatgaagatcttgaaggacaaacttcaatgaggagaatgcagagcatcaagcagaatagcaccataaggtctcttaacctctaagaattcataacaagtatagaaatatattaataaccaccagatgaccgtgctcttccgtacagtacttatgattctgacagctgggtggcttatgagcaaaaatgacgggcatgggctttactgctaccctgagtcaatgtcctgcctgattgtctgtgccttctcttgttcttgttgtagttctcttgagtacatgtcctcagttctctctctgttatttttgcatctctggtccagagtgtgggatgtctggacagcaagataggtctgtgtggcaactgtaggacatcagaggcgtagagcattagatggcactagtggtacccacttccttctccatgtttgcctggtatcttagcctcagcttcgatatcaccttgagatgatggaggccagatgtcaaaatgtcagagccacaaattaaaccagctttgatccccaagttatttcttttgaaaaacataaacttggagagccatcgacaaaaggggactttacatgattaagaaataaggattaggggctagctagatgggttggcagttaaggacacttgttgctattgcagaggaccatggtttgtttcccagcacacacatggcagctcaaaactgtctgtctataagggcagtcccgagggatgcaacaccctcttctgtcctgtctggagagcacaaaacacacatgtggtacacagacatacatggaggccaaaaattgaaatatataaaattaaagtaaatctaatatttttaaaagatgaaataagaattaaatttgaaatcttgggatttcaggggtcactttatttccatggtataaccttgcctctcctaaacactacagttggtatctgcctgtggccgacctcacgggtaaggctttcgattctattatttgcaggttgtttctcctcttaaaaactgaatggaacgagacctttccaggaatcctctcaagctgcagtaatggtttactgaagcagaaagaacatggttattttgagtcacaaaagaaataacaaagcaaaacaaacttaggatggttgccttcccttctaaaatgtaattaaaaaaacagaggcatatggacaaggggaaaataccaacaacactgcctgatctggtgtggatgtgttcctggaaagtattaattacacgcttatgccatttaaaaatattaattcagatgcacgcagcttgcaaatcccttctcattctgtctgctggatgactcgggacaaagctagctgtgaattaattgattaataacaagctgtgctatgcatgttttcactgacaatatccttgggacggcctcttggagccaggcttctgcttgtgggagaattggttttagtacagtgtatatttatttttacccctattctcaagctggagctttgtcatgttacacacagggaagtgacttgtctgctatcctaaaatatggtgggactggtcaagaagaagagagagagaaggtgggatgtcaatcagaagatctgtcccatcgtgcattcttgcccagggcatggactggctggagcccaggaataggcagcctgctgagactatgacaaatgtatgacaagagtttggctcagaggtactgagcactggacaccatctggagtcctcctttcttctccatgcttgcccagggtctcagactcagctcatccagagccacatgcaaatgacatccttcagggattgcttcctcggaagaatgtctacacggaggttaagggtgagacctgccaagatggcaaggcttgccttttccagcacagattgtttcttgaagaatttctttttatctgtatgtttgcgagttagttgagaatgaaagtttgcctggaggtcaggggagagcttaagtgtgttagttaggttcagctggagtctgctgtaataacatgtaacttccacagtggtagtatgacataatttgtctcgttttctacccccttcttgttctttttgttcttgttcttcttcttgnnnnnnnnnnnnnnnnnnnnnnnnnnnnnnntgttcttcatttctttctctctttctctctttttctctctctttctccctgccaacacatcttattgagtacccctggttggccagaggtttgctatgtaacccaggcttgcctcaaacttacagtgatcctcataccccctatcttcagagtactgggataacaggtgtgagatgccattcctggcaaagattttttttttaaccattcagtgtaggtatatattagtcatgaaagtgtgagtgcggaaagcatggtggctcttcgttataatccctgatctagcctctcgacagtgtttatacatcttggcaggaggcagtggtcaaccaacattgctcatagcatattggctaagagaaccacttgaccatagttaacctctagacagtcctactggctatccagagagaggaaagaagtcgagtgtttgtgagcatcacttctgacttctgaggtgagaaaggtgtgggttaaggagggtttgagggagagtcggggaccctaagcttcttagggtcacatctctgtctgaagcagctctgatgggaaggattggggaaggaaaaaaaaaatcttcatttgtatcttgtcctagaaggaactaagaataactctaaatctatacaatctcccataaagtgtgcaactcatatccctgggagcttcaacagcttgtgttgttcctaaatatctctatatgggaatgagggtaaagtggtatcccacgagtgcactggggacagaaagaagtgtgtcaaaaaaagtgacatagtcaagatgcaaatcgtttaggccaagtgagaaagccatacactttgggttaggctccaaaataagccaggttcatacacctttcatcttcccaccaaggttatgcacttattaaagtcaaggattatttttctttgtatgtcacctgcagtgtcccaaatggctctcgaccaaggggacgcttagctgcttagtatgtcttcaggtgactagatgcaggatgagtatgtgtctgcttctccccgtgcttcagaagccagggagctgtggagtctcctgtgcaagtctccttggtatagttgggttctgtgactcttaagttaacagggctccagggatatagaccttcctcagatgtcctctgctggtcaaggggaccagcccctcagattataccaatggcagtggcaacacagaaagcccaaactgcgagttgatggggtgcatcaggcaggcaaatgacagccacatgaggaggcagtgggcatatgggtaatggtctggacactgcattgggggtctcctttttttcttgcccattcatttgattattctcatttgcatgctgttacaggcttactctgtccaaaatgagaaaaggggattgcaacatcatggtcacactttgtggggaaggggtcatgtaaatgcatttgcatggtctttgtcggcagtattttttttttttttttagcagtatacgtattttatgacagagtctaggatagagctagggatcagtgacagacagagcctccgctctcatgggctgcaggaactaatgtggtttttggatgtgatatggttcccctgatgcatacagcttcacttttctcactcaactatggaccttcagtgttaaatggaaatttccagaaatcaacatctcatgttttaaatcacatttattacagtgcattcctataattgtcctattttattttttgttatggctattaatttcttacttgtctcatgcataaattacattttatcttaggcatgcagtgcaggaatatacacagagagttggtagggtttctatgtctccaggcatctgctaggggttgtaggatgtgtcccctgggtttaaagacataactgtgtttataataagctaaaaatctacagatattgaccaaatggctttagtctactgggagacacaatacacactcacatggaatgtaaaacctgagtttcttagggccacttccctacctccaggagctcagatgggtatatgaatcccaaggaccaaaagtcacggattgttagtcccaggtgagaaagcacccacatggcatggcagatggacagccaaggattttggaggaaaagggtagattgcagatggctgaacttttaatggctgtgcaggtttgggcttgagtccctcctgtttccttgaatctctcatcactaagaagttgaaaggttggtgtgagttgctgtcttatgcctccctaccctgtgtgtgtgtgtgtgtgtgtgtgtgtgtgtgtgtgtatgtatgtttgtgcatgtgtgaatgtatgtgtgtgtttgtgtatatctctgtatgtgtgtatatgtgtgtgtgtctatgtgtgagtgtatgcatttgtgtatatgtgtgcatgtgtgtatatatgtgtgtgtttggtgtatatgtgtgtgagtgtatgtgttagtgtatatgtgtgagtgtgtgtatgtgtgtgtatgtatgtatgtgtataaatgtgtttgtgtatgtgtgtatatgtgtgtttgtgtgtatttgtgatatgtgtgagtgtgtgtgtttgtgtgtttgcatatctatgtgtatgtatgtgtttgtgtatgtgtatatatgtgtatgagtatatgtgtttatgtgtatatgtgtgtgtgttcaggtacagatgcatgtatgaggatgagtgggcatgtagaacccaagcatcaatctgagctcttattcttcaatatctacttggattttgagacaaggtgtctcacttggacctaggcctccccagtttagctagtccagggatcctcctatctctgtgctgggatgacaagaacatgcaatcatgctactataaatgctattctcattgctttatgtaagaactggcttctaactttgaagtggttagaccctcacctgagggtttgaagaggcagtggcccaacaacccttgtcccttcccgcctaatgttccaacctactgaatgccatttgtcagctttggcctttttccaagccatattcagggctcagtcgggaggcaagtggacccctagaattccaggtagcaagtttaggggacagggcatagatactggggaataatggcattcagaattccaactatccccaatatgcctctagaccttcctttatgttcctgaggccggtaacagtcactcttgtcatcactgccaaaaccaccaccagtgccacttgctttcctagttacacgaaccttgacttaccaccacttgatcccaccaccccacctgtactctatggctaatctcaggggaatccaaatatggtccccatgcagtccccacagagggctttttacagctcatgtccattatacagctgtctatgtgagacaagggccatgatggcatgatggccaatgtttaccaccagaagcgaccttcttgctttggtggctggagaaccaccctgcttagtgatctgtaccacttcctggaggacttttgatgggacttgacccacatcagaaagaacctgctttgcctcaccctacccctggcttcctgcttgagtgatcgttcctatgatcactaaaagtgttcctttggatcctacactcagcttgctacttttggattagctttgaggggcctctgggttgaagatgttaccctcactttataagtataggaaaggacatgccttgttaaaatgatatcttcagggctgccttgtctgagactcacagcttgcctctaagaaccctgacccttactatcttgattttggtctgtgcactgtagacatattgctctgagtctcagagttatgagaactgacccaaattgcccatgtgtgcctatcttggtatcatagacatcatctagtcagccacatatactggtttgggcagaagctgtgtttccttctctgtcaagtagctgccaacccttttcctcactagtatttgttggcaagacagtaaaagcatccatgagttaaagacacagtgaaatgacacttgaattctccagggaatgattctgctatgatggataaacatgttaattactcagaatttaatctccagctgccgcctttgtggcacttctccgcacagcccgagttgggggccttgcaggctggagtcaaaggagctgtctgaccctggggaatatcccctctctctaaattctgggctgctgtgttcatggggcacctgggcatacagctcaagtcttttcctaggaggcagcaaatgtagacagttagagatccccagctctggcactcttgtgtcctggattcaaatcccagtgcttctgcttaggcatctctgccccacatttcctaaccatgcagtgagtggttctaaagatgaaatgtgtttatatgtgtaagagacttcaggggaacctggtgtctaagggaagcaattgttaatcgtgttgtgtattgctttgcccctcccgtaggctttgccggtttgtccttttctttattttactgccacctcctttcttctcttgggtaacttgcagctcattttttttttttcctgagtctgattttagctctctcagcagagaggcctgagggcgtgagatactcatatagacttctaggatgagtggaacctacccaccggttcatttcattaacacatttcacaagtgggatggctcagtgtctgtgacttcccacacgagcatgagggctggagttcagatcccagaacactggtaaaaggcaagcaggcattgggtcacttgtaatcttagcactgggaaggaaaagacaagcaattctcagggcaagttagctggctagactagttcgaattggcaagttccaggttcaagatgaggccctgcttcaataaataaaatggaaatcaatcaagggaaatccccaatgccatcttttggcctttgcgtgcacatacatgtgtctacacacacatatgcattatttatgcacaaacagttttttgtcctttaaaaggagagttaggtatatgctaggtcatgtgtcaagaagtgtgcctacaacctccatgaagatatggtctgtgactctcagtacctccttatgggaagcagaattacaaatgagccatactccacagcatgaagtagtggatgttttgacaggaaagaggattttctccactggagcctccatgacacctgcatatcttgagaagcacagggtcgtgggattcattgtctaagacctgtgactgaacaaggctttggtgtctcatgtgtaacattgggcaaccattttggcttctctaagacgcaatttctaaccctgaaaagtggggatagctactataggctgatcaggaaagttgaaagtgagcacaggtctgaaacactcagaaaactcatactgccaaccaagaaaatgagacaggaatccctgttaacccaagtgggatggtcttcacctttaacacagcttgcatctcagaaccttcgataatggaacaaggtgcctagtttaagatacctcatactggggggtgggagggtgtcttattttgattttcattgctgtgaagagacaccatgaccaaggcaactcttataaaggaaaacatttcattgggtctggcttacagttcacaggtttagtctcttatcatcattgcaggaagcattgcaccatgagggcagacatggtgctggaggggtaactgagagttctacctctggatccacagggagcaagaagtgacagctacactgagcatgaattgagcatctgagacctcaaagcccaccccctaatgacacacttcctccaatgaggccataactcccaatagtgacactctctatggcctttgggggtcatttttatttaaagcaccacaaagtctgaagcagcaccctatttatccaagtctccttggttgccaccttttccatcaggtcctgccccatgtaagccaagcagctggaagggatgactccagcctcccaagaaactaattaagggctttccagcttgcaggttgcattccaaaggaccatgaagtcttggctcatggcactaggatggttcgtgactggtaggatggttaagagtgtcaagaagatccagtctccacaccagaagtagattaatatcaccttgacttaaatttcctgatggggaaatttcatcagcatttggtaaaaaacaaacaaacaaacaaaaacaaaaaaaataaaaaaaaaacaaacaacatctcagtatcaacaggtgaagtaacccagctgctgctgcctggaagtttgtgtggggctggtaggggatacttgggggtggaggggatgcagtgaggctaaaggaaacagcaggaggaaagcactgtgaatcttaggtgtagaatttgcccttcagactttgttctgaggtttgcctgcccaagaatgggttgtggaaatgaatttagaaactagtttccccagccgccccactcccagaacatggttctctcccctccttatcctcctgtgtatttatgaacacagtaagacttatcctcagtggacagctgatgattcccagctttctagggcatcgtgacgaatgtgaccacaaaagaacaaagaatagcattgggaggcaggtggaaatggccatggtaacaagaggacaatcttgttaacctcccaccccttcctccctgtcctcccccattctctcctccctctctttccctttttcctcttctcaacccctctctcttctccctcccttccccttctctcttcctcctcctccaccctctttctttctcttcctcacctgttggtcttcaccttctaccatgtttaaaaatgtttcacttttttcactaaaatatggcagggtagctattccccctactttgggtatctcctgtctctccctgctatcctgttgtaagaatatggaattaaacacacacacacacacatcattgtttctggggggaggtttgtgggttttaggaatccaaacttaagtcctcacacttgtaaggcaaaccccttatacatacagctatctctctagcctacattaggattttatgaagctagaaagattccacattgagttgccaaggaaatgtgtcccttagatgatatgagtagtgtagcatcgggagctacacaagaaaatcctagtgtgggttgttttcaaggtagagtaaagttattcacctggggtgtagcagtggaaactctgaggtgtggtacaaatatttacggaagcagttctcatacatggtggtatataatacagtcaagaacagggtcagctcaatccattataaactgccaaatgtcctcatcttactaaggagggcatgaatccagaggtcacgtagaaagttagtagtggcggcactaagactgtaatgctatccagctgttctgtcacagagtttttccatcagaccacattccctccctaatgtttagctttcatcaagccccttcacctgtcagcattttactaagcagctatattctttgacctggtaggaaagacactcttggcgatttggtttggcacttggcatcatgagtctggaagagttgaagtaacttgcttcaaattataagctctggtagattccaaactccaattgagacattggacagtctaaaccagtgctttccaaaaaggggcacccataagagcagcatcacctggcagtttttaaggatgcagactccgtcatctgagtttgattacatcctcttggtgattatgacatatgctcggctttgagttggtctatgacaggtaagctgacgaaccttccaggtgtgcctcagccactcattactatgctttctaagtcgaatcactgcttcttgccaggagagaaacttcaaggtcactggcacttcttagcagctcattttctggtagtttctttggaccatgggattcttaaggaagcctggcactgatgccccgccacccagtggggtctctgagtctgaaggaagcctaattggtgttgttgaacctttggggggcctgaggagattttgtgaatcctgtctgctttcatgcagatttgagcagtttgacccagtcgagtggaaaattaaaaaaccagaaaggaaggagatataacttgagacaccaaatgttcattgcaatcagggcacttcctgacttctatatactgcacttgggagaccatgaggagagctactgtcatttcctacttgattcactagacttctgtcttgtgctttccaaatgccaggcacttggctttagcatctttagtgtataaagatgaagtgatatggtcccttcccacaggaaactcactgtctagtgtgatgtctgatggcagtaatttctatcagagaaaatgtagtggcttttaattgatgcagccaacctacaaggtctagccaatagaacatcgcataaaaataatcctctgattgccccactggccaggggtagcttcgcacactgtgtaaggcagcgactctctggtggtgtgtggagtaggatctgataaaacacagtgcaggggggagggtctgatgaagactttcttgtttaatgaaccatgtcactgtgaacagctgtggtgtaactcagccagacaactatgcaaaccagatgatgtctccagtggattgaatcagctttgatttggtttggttggttctccaaaggcaaattcttccaagttgggtggggaataaaaaacaaatcaccatcccaactttgcttttaacttttaattattggatggcttttactttcaagtcttcgaagcaaacagggaatggctgctacccagttagcagcaagagagggccaagaataatcatgtatctgtaatagctattagtgtactgtgcataagactcgcagtgtgttttgttgatgagcttccctgtgggtctataagagacagaccaaaccaagaccattcctgattagtcctcagaacagtagggctccagctcgccaagctgtcaccttccgttacataccaccaaatgtgagtgcccagctgaacatcatgaatacaaatgtgttccatgtgaaactcttccaataccctcaaccattttcaactctaagtgccagtgccactgtgggtcatcactagtgtcataaaaaatcaaatagaatataatgtcatagcacatctcttcatacctagttgggttactactgcttcgtgaaactaatttcatttgtatgtctatggtatgcaacctctgaacaacattgtaaaagccattgatgaaagataacgttcacttgggatctttttcacatccaaggaagcaaggcactcatgtttggtttgcatgcgattgtaagattttgggctgatggtataagggtatccagagagacttgagaccaccttgatgcagagtggatttaccaagtctgtaacccacaccagctgtagaccagaggcaggagtggtgtttccatggctatctgggcctcactgaaggggtcactgtcaagttaacacaaccaagttggctaatgagcatatacaaagcaacagcttagaagcaattctgggaagaacagggtctctttgtgctatgttctgagctgttcagcaggggtacaactgacacccatacccacagatacaaggctaggcttacccaggcttcctcttactacatgtctacatctgatacattttgatagtttgttttccagattttttttttacttttaaaatttttatttattaacctttataaaaagatttatttcacgtatgtgagtacactgtccctgtcttcagacacaacagaagagggcattggatcccattacagatggttgtgagccaccatgtagttgctgggaattgaatcaggacctctggatgagtagtcagggctcttaaccacggaaccatctctccagtctctattattaacttgttattgattctttatgaatttcacaccatacactctagtcccactccctatccctttgtatctgccctccacctttgcaacctcctgtacaaagaaaataaaccaaaaagaaacaaaaccaaaccatctagtcatggaagcagtggcatgtcacacagttcactctcttgtccttacatttttatttagaaatgtgcattgcaacaagtcattgttctggcccgaggcctctggcctctgctacactgtcagtattggatcctcactgggacatctctcagatatcctgctgttgccccgtgtcatggagaccctgagctttgcatctgtaggaccagccccttcatgtgctccagcagatcatagatggggtagatgttgaggtgggccaactcaaagccttggatcttggcctgggtggtagctgacttggtcagcttgccagctctcctgcactcatgccaccaggactagctctccagcgcttgccccgccagctcacccaatgcagcagcaagcaaggggttgagccagctctccagcgtccatctgtttcactcgatgttctgtttcatttgcttctctcctctactctgttctattctcatcccatttgtaaaatgatggtaaaggctccctaaatcaatttaatcttccactaatgggttacaacctgcgacttaagaaaaaaaaagaaacaacaacaaacaaaacaccagatcacattatattaaaactcactttcaatccctaaatcctatgagtccaatgtaaatcgccactgttatattagggtatgagattttatgtgccacaggttcctagttaaattgttggctcacggaaaaccatctgttattaattcactcattcattgggtctgtcattcattccattcattacttaggaaccaggtattatgtgaggccatgctgtcctcaagtaaataaaacagaggagcccttgcttttgaaggcaggttccctggggttgccaccatctcagcagctccttgcttagggtttcctttgagagagaaaaatccttgaacaaggagtccatcacaccacccctgtgctattgagtgaaatatttagccctgaatcctggtccactggcaaggagcgtcacattctgaaaatgacctcagaatgaacataaaccaagacgcaccatgctatggaagccctatttcctcttgtcttgctccctccgcagccccccaccccatgcaagtagcttaaagggaagagaaatgttccctaattacttgttgtatattggtttgtcttgtccatggaccactaatcctgcagaccgacttgcagggcctcataaatgagattgctcagagcagaaaactaatcagatttctcacatttagctcagctctctgctagactttagggaagctcagcatacaggctcctttaaccatttcccaacctgaggttacccttcatagggccacagtgatgcagaggacttgaatgtgggatgaaggctgcaagctggatcttccttaagtctcagcaacctcaagccacttcctgaagaccccttcccttcccctctatccatttctcaatccacctcctgccattctccacttgctttgtgtccatcctctgtacccttgtttactgctgctcctcatccctcatttgagcagcgaaatagcagtttaaacactcccttaatgggctcttgtgtccgcaggtccttgtgtgtccttttgtctggaatgcccctcctttccacgctttcccctcactgcagcactctcaacaccaaataaagtgagtgcccttctccccacagtctctttccctaagctaacaggactggctgccatctagaggactgtgcacttctgaattggatactgagctctgtgatatcagtcacagggctggatgtggcactgtgaccttctggttcaattattatattacctgagagccagaaaccccaaaccttgtcagcggtgtgcctggtgtgtcccctgaggtaatccattggaatgacagctgactttaatcagtaggagaaggatctgggagacgagcaaggttcgcctatctcagtatttacagaagaccatgctcctccagtgcctgggttggtgaggctgatccttactcttgaaatactgggatttgcctgtgactcaagtctgttccagcattttctttgacagatgagcaaaccaaggtctagagccaacgtagcttacacaaagtcaccaagaattgtgaccgcccacatagggggattggttgctttggctttggggaacagggcctagtcaccatttctccttcctctcatttccactgtcttctcttaggtatccttgtcgttccttagagctgaaagacagggatgaaggagcagccattgccatggcaaccaactgaaagcacagtcaggctgttctctctatggctgtggctctctggcggcagctgcaggttccagtgctgggccttaatggtggcactgggactattcaccacacttatggaggagaaggctgcttaggaaccttgatgcgctccaacataaatcgcatgggctccgcagagagggaccatgcaggcctcgagttctctttgccttctcctaacaatctctctctgccagactcctaatacggtgtgtggctcctttgagaagactttggtctttggatgccagcatcagacttctgaacagacagtgactgtgatggggatgttctgtttttcagtctaactgaagaaagtctaaaatgaagatagagttgggggaaagaggaaagaagagatcctatttcagtctcccaaaacttccatttatttgttaaggtggggccttaacaacaaatggtctgttctgttcccgtggtcctgggagtagagggggcaggttttgtgggatggttctatctggtcatctcatctctccttctgcctcaatgcctatcctgatctctcttgtttataaaatgctctagaggagctcccatcctaattcaccccacatctcacagtgccccactttaaggctgtcctcctaatggaagggatggatggggtggggtggatttctcttgctgtctctgaagctcttctgtctatgggctggagctcagaggcaactgaggttaatgcagcgagctttgaacttgaacttcaagtctcaggcttttatgatgatgacgagcatggtgtgtgtgtgtgtgtgtgtgtgtgtgtgtgtgtgtgtgcccttaggtgtgagcacatgcatgtgccctatcatgggacatatgtgtaggtcagaggacaccttttgggaattggttttctccttttgtcctgagttctggagatggaagaccaattatcaggtctgtgtggcaaatatcttttacctactgagccatatcactggctcagatctgtttcttctctctctctctctctctctctctctctctctctctctcccctctcttctctcttctcaattctattctctcttctcctttcttttctctctcctctctctctctctctctctctctctctctctctctctctctctctctctgaaacagggtttctctgggtttccctgttgtagccctggctatcttggaactcactcagcagaccagcctggccttgagcttgagatcagagatccacctgccactgcctcccaagggctgggatttcttatataaccacattggtgttttgcttctagaccataatctccataagatgctaacatgcatggtatctgaggcagctgctcaagactgacctggagtgtccttggatcaatacctctgacatcagctctccagtgcttgagtcgtgggtcagctgtatgggtttaggattgcagtaggggtattagaaagtcaccaaatgggacttggtcactagtgttttaacaagcagcacagtgcgactgtgattgcacattggtctaaaagatcagttccagcaatttttcaaggtgctaagtgaagtcccgcctctacatctttgtgccaatcacccacatccccatgctgtgactgcctctggaatcttaactgtcatactaccagagagtcagaaagcccaagcactgtttgttgtgtgtatctgatggggtctcttgagatgatctgttaaaatgacatctgacctttatcaggtgaaggacctggaggctcactgctctgggtaatgcatggactacccatgaagatccaattcagatgcatccatatctaggaatgtgcttcagctccaaactgcatagcctctgctcttagggcctatcaagggggaggaggaaaaggagaagtttttcctatgtggctgatagagaattgtaattgagtctagtaatcaaggctgcagatgtggcctggggagatagttcagtggatacaggcttgctatgcaagcttagagactgatgtttgggtaccaaaagcccacacagaacagtgtgcctgcatgtactactagcacttgggaggtggagacagatgatcacccaggacaagctgggtaggaaaactagccaaattggtggcctctggattcagcaatcagtgaagttactggcatcaacctgtggcctgtttgggaagtgtatgaaaaagaattgactagatgttgtgggtacttactttatgatcagatactcatggccattatttctaggtgtgagtgtttgtgtgtgttagagagaaagagagagagagagagagagagagagagagagagagaatttgtcttcaccaagcctcaagcatgatttcacagcacagtgcttaatacagtcttctgcaccgtcacccacacatagtgtaccccatagacatgaacacacatgcacatgtatatcatacatacgtacacaagtcagaaaagaagaaaaaagaagtgtgcaaagcttttataatattgtaggtaaggaactgagagcagaggaaagtactgtactgctcatactaatgttcagcagaaactcttgagtgttgagtttcaggcttcagactctgcaggcttcttgctcatcactgtcccaggacctggcctgctcctggagcatcatcctttgtcctttgaccttgcacatgaccctaaatcacatggagaagattcgggtagagtgtgtatgcatcagtctggataacagactgtaaggaacactgaagctaggcagagttggaatgggaggggcttcctctccaaatcatgacgtcacttgctcagccctcattgggggcagtaggagaaataaaatgcttagtatctttcttattcctcagggaaccatggctaacatttattaatatgttgggaaagaggcagttttgctattgataccttggttggtatgtgtttatatgagtatgcatgtatgtatgtaagtttgtatgtacctggaaacatggaagtataggacagctttggttgtcatttctcagatactgctgggcagtgcatttcttttccctgttctctcctttccttttcgagtgattgtaacttgctgatctagaagcccagggatctgctagtgtctgcttctccagcactgggattgtaagcatttgtgaccatgccctggtcatgaccaagccttcctttctcaaagttcaagactttctttacacatgtttaaggattaaacacaggtccccatgctagcaaggcaagcactttgctgactgtgccatccctctggatttgttttttacttttatttttttgaatggaaactccttagacagatttattttgctaccggggaagtaccagccagtttgcaatcacctgagttatggaaacatctggagagttcatttaggctcagaggctaggaacatgtgaggacttgcatgttcatatgtatgcagttccctccatgagttgcacatttccacatgacatcatggaaaaaaacccttcctaagctaactcacaggtgtaaacacgctcatccgactggatccagtaagaaaatacaattttgataacaacaacaaagcatatttatgtactcagttgacgtggctgttcagggtgtggaaaagacaattgagatagctaggctcctttgggagaagaagagaaactggcttttatagacacaggcagtagcatggcacatgggcacagtctgcgttgtccacttggaggatcagaattcaagcctgaccttgctgcctttttatttgtgatcttgagcatctttctgatgctttgaacgtgagtgggagctggcagtccattcacagtgtctccttaagagcctttcaaggataaggaaacctggtatcttattgataccaataaggcatgcaatattgagcctcctggtcttagactcagatccggtacaggcctgcgtgttgaaggaaggacccatacacagccctgggctgctattttggtggcatgtcagggttaggaaaccagcagctgggtggcttcatcttcccagttgtgtctgggcagcagccggtggcgtcatcttcactgtggcgatctggaacagctgctggggtttaagcgtgcacttagaggaattacctgggatcgtagccggccttactgaaagggaacacatttctgtaagccgagctaatgtctgaggctggcgcacaggggctttccttccacagcaggagagatatcaacaacaggaccaggctgcctggagaggctgtcctaaataggaaccatgatttcttccaggatgcatttagtttggactcaggttggagagcatatgaaaagactgggtatggtccagagatgtatttttcatgtcaaatgcttaaagtctctaggtagctctaggcaccatggaataatggatagcttagctacaccttgaagattcctccataagcacatttcatgctattcccctgtatgtctgtgtcacagtggtcccctgaggtagttccatctcttcctagcccaggtagtctgaagttattcacctgtggccctacataggtggggatactgtggctattttctggtgactttatcttcttgtgagatgtgagtgacaaacatgcaattactagacacaaataaagagaatagaattgccaaagtaaaatcgaacttaagtgaggtcgatgtgtagaggtctgatagaaatgcccctggagctctggaaagacagaatttggaagcatggaagatattgaccctgaatcagcctagtacatctttgtttagtagtgcagcagattcaaacagcctctccttgcagcctgccctgcagccaatgaacctggagcctcctgcaatatttgaaaagagaagaagacagtggattttctttatgtgtcattttacagactaaaagaggatgaatgtctcatgttggtctggccaggccaatttcataccaacctggcttctcaatggcttccagctctggccttggttgctgagttgtttccaagcacattgctctttgggagtaatctgctgtattgttggtgcaacatccgttttgcataaactgaggcagatagctctggacagcctaacctgtgagatgccaccactgttcatctggtcccctagcccaggccactaccactgcttgtgtaggcagctgtgatggtaggctagaagcctggtgacatttcctcctagcagtcccctccccccttcctggcaagagcatctttcttgcagcaacagtaaggatctgtctaagatgcttttctggtcacattaatttccgtctgaaagcttgccagttgtcccctttgtgcttagaagaaaatctttgtcgtgcaaatccttaggaaaggaaatctacagaaagagaatcttacaggttttacatgacttgcctgacccaggtttttttctgtgttgggttgggtttttttctgtgttgctgctgtgaagttccactcctgggggtcactggatttgtggaagctcccctttccgtctttgtactagttttgcttatctccctccagtttgccctttaagaaaatcactaccagcacggcagattggccattcctgttcatggtgtctgacctgtttctgtactggtttttgtttttgtttttgtttttggttttggttttttttggtctgtttaacagtctatctatctgctatggtttatatctggacagtttcccaaagtcctgtgagtaaaaggcttggcttcttgcccatgatggtactggaggaattgaagccatgtagggtgtgcccttgaagaacattgtgagactctgatgtctgtctctatctctgtctctatctgtcccttcatctacatgtcttgcttgtgccacgatttgagtagcttgtcctatcccaggcccgtgagcactgggtccaattatacacatattgaaaactctaaaacattagaagccttttcttgtataagttgattttctcaaagtgttttggtatagtaagagaaagctgagtagcacactgtgtcttctcatgcatgagagctgtctgggaacaaccacacttggatcttgatttacattcttgtacattatactctaccctcaggtctaagaccacaagaaagacagctctggagatgttgctacaggagaattcatagatggattacccaccctgttgcctccaacccttgcaggatctaaggccatgttcacaggatgccaataatcaagagaccttcagattctgagctttcctggcaggttctgccatgcttcccactggccaagaccaccagtggcaaaattagctctaagcaactcagccagatgtttccatctgcagaagagtattatgcctgcactcatagcagaggaaactttttactcataaacagagcaaatttatagtggaaatcagtgggagggaataaatatgaatccccatgaagtcattttgtgagctgctttatagattgtaatcacccatttagagtttgcaggctattaattttgtttggagagaacctcaggactcttgggggcagaatttataactctgttgtgtcacactcatgggtctaggccttgaacccctgaaaggtttggaaagaaattaacaagctacctctggaggagttggggcttcagcatccttttcctgtggttctcttggacatgggttttaaaaacacacttgcccagtgtatactgtctttgttttgccccagactgtagatttccccctgtgagctgaggctgttaagttttactttcagcaaattgtagtaggaatctgtctttcgagaactgggtgagacctatggaagagcagcctgagtcaagcagatctgggtggactccagctaggctatttgacttaagattccaagataaattcaccgctgttaaatttgttcaaacgtccctttctttataaataagaccagtgccccagcctcaaaagtgataacaaggataaaggagatgaaataggaaaagcacttagtattcaaaatgacttagttcatacagtgacggagctgattggcgattcaaagtaagtctggtagagcaggaacaaaggagaatgtaagagctatgatgctggtccccaactgtgtcgctgatgtggtgggtgaccttggccatcatagcctctctggttccagatcttttgcattagtgaaatgaaatgtttggctcaaattgtctctgagcgaatggtgaggccagtattacctttgggaccagttagagttatagattctaaggctctatcctattccccttggggcagaacgggctccatcttctgcatctggatgagttttccaggtggttgtgggcagactgaagtctgagcgtcatcactgtgatgactcattgtggctatggtattagctctctagttttcctggtagtgtcacttctagagcctctctccttggggtcttggaccaaaacaggaagcgaaacactatgctaaccaagattcagttgaagttgggctcaagagggcttgatattgtgttggagtgtataatctctactttctgatttctcagggggatgacctctgtctccaccttgcctttaaagtgactttagatgaggtaaaaactcatctgtcatttggaatgcacactgacatgtgggccgtaaggacgcttgggggtggggccacatataactattattatatgtgggagatgggctgtctccctcagtatcaaccttagtctcatgataccatttttcttgagactctatgtgaagaggtacaagatgagcagtgaagactcaggcctgtgctctaggaccttgaacaagtccctttaactccagttcccgatgctgcctccttataataggaggatttgcatactttttgctactgagccttttgagtaccaaaactggatcaaattctgagaacagagcagagaaaggcagctgaatcccggctcacatctttaccacttcctctgggcactgtgcttgctgtgggttttgatgagaagatacataagagaagttattgtagctgttagtgatcatcaggttatctactccaagtatattaaggagctaagccttcttggggatttgcgatccactatgccctccaacttgtgcgttcccctatcctgttttgggctataattgtagctgtttttacagtgctgctgtgactcgacccaagctgtctttgcccattgctgcttattctctcccctggccttttttgttttgttttgatttgtttttagtgagacagatgcatacattaggtgtattagggctttgctgaggcagaaggatgcagctacagggggtgggggcaggaatggaagcgagaagcccctttcaagtagtgattgtaccatttgtcttcaggaaaggtggattaaactcttactggataactaactgtacttggctcagcccttgagctgactgcatacaggggaagtctacctgagcaatagggaaggggacgaggcagatcctctgtgaaggtcattgcagagcagtgtgtggactctgctcaccattacggtttggtcattctttccatcataaccttgtggatatctgctcacaatccacatctcaggaaaggtacaaggagggagaaaaaaaatgaggtcttgggtctctattctaggagtttgttttctaagtaaaaataagtcacaggggaaaaacataccgccatttgtaagaggcacagtggaatttagagtttgagatgaacaggcagatggacaggaaatgctgtctcaggtagaataaaggagagattcatggactgggacaaggtctgagaggctagaaacataagcaggtgaattttgtaaaggagaaaagggagaaaagtctcagtgtgaggccactggcagatccataactgtgctccacaaagaggttgacataacttacggcctggtgtacactattttatttatttttaaatcttctgattgatgctctgtagggagtgagtttagtccagagtgaatgtaagtcatttcatgccaaggacgtatgagaaattggtaaagcccagcccctcccccttactctctcttctctatagtgctctcctattgaaaccagtttttcccaccccaccccaccctacacttgctgtacataataagtgtacagaggctctagatgctgtgtagttgttccaccccatcagaatgctcacaacatcaggcccacaaatgtatctgactcaagagcacatctgtatgtgtgtctgtcctgtcttcattctcatgccacaccagcctggtttccaggacccgagttacaaggatggatgcagtacatctgtgtgctcactgagtgattgccctcttcaggatgataggtctaagaaacctaccagccgttaatgatgtccccaccaaggtggcccttgtacgtttcagagcttatctgggtttgggctgtgctaaccttgggctacacagggaccttggaactcccaagtaactgtgtatgtgtatcactggtccctctcccaagttaccatgtagacaccctcccatcaagtgccttgtccttgttgctaatcatcctaccaccccctgactctctttagtctggagacagtttttaactcagacctcagttgttcccaagcctacttggcagttcctacctcttcaacaaaccccaatggaataaactggaagtctttcccaccaagccacccatcttctgtctttacctgtccccccagtaaaactactgactgaatttgagtaacctatttagaagataaatgtatcctgaacacggttctgctccctgctacagagtctctatgtatatcagctagtcttcatcttggagcaaatgttaactaggtttaagtattgactcactcacgggccactgacaatcaagagggggcagctttcaactgctgggtggacttaaggcaaattctaatggattttccccatctacctctaaagtctccacttgtaagtttactatcataacactcacccctagtcctcattcacacagaagatgcatcttctaaaaccaaaggtcttcctcccattggctctcataatgatctatgcttcatggcctagggactcactgctactgagctctgaggaaccaggttaaagaagcatgtggatactggtgccagaccctgtaaaatatgtgtgttgactcttttttggtatatgacagatgtcaaggtatactctgtcacttctcagagtccctggttgagaaagacaactgcagggtgaagatgatggccttgctatttctcagtctcatttttcctcctactggccctttcctgtttacacattttatcttcctgggcaggaaaatcggagagttgcctaagaaagccttggtctatcagtatgccccattgctgcttagtgttggtttttggcatcattcatttgggacaagtagtgatgatatgacagaagatgaccgtctggtctctagtgtcaaagatcatatccaaaattggcaaatcaagtaatttaacgtaaaaactgacactgctcagtgcaatggggtgggggtcggagctggcaaggcacacatcacagtctttcatcctccatctcactgttgatgaaaaccaaagagatacacagtgattgaaagcagggatgctggacaatcatttcattggctcaaactctgtttgtgaccagggcccagggatttgcttttctaatggttccagtgtatactggtgcagatgctgtttaggttacaggagtgagggactgggcttgcactgcctgcctttggtccccgttggaaagttacagaaatccagggaagcaggggtttggaccaactgactttgcttgtgggtgcttttaggatgaaggttgggttggggaagtggatagtatattaggtagatgtctttggggggtcctctccattgaagaaccaccttcacttggcttcagtatgtactaggagacaaagctgctcaagagaagggaaccccaaagaatgagagaagatgtaggcctaccctagaggggtgaaaaacaggatagtctaaaaaaggtacccagcatagccttgagagatagggctagcgtacactttgatcgtaaaagaaagaacaggccggtctgcccaggtttttcaacaccctcagaactgaactcctatgtttgcaacagagtattatttatttccatctgaaaaaaaaaatgaagaaagtgaggagttaagtaatatgcacaatatgtgtgttgggggaaagaaaaattcagagacacaaccctcctcagatctagattgacaaacgcagaaaagttggtaaagaggggcttagaaaccagaggtcatagggaaaactacccaggtcttttctgtgctaacattatgggctgaaaggatgtctggataatatctccgcctcccacttccttgagaagacagttaaatgagctaacacttgggaaggacccacctattactggcaagcatatggtgcacccttcagacttaatcacctttctctatttgactctgcaacatgcttcccatgctggtgaggcaggatgagagttggtcatcctttgtcttaattggcatggggtagccaccaggcttcctaaactttcctagattgggctttcagatggactgaagacattaaggtgttgtgagctgccccattaccatgatttaaaaggatctcaatgcctcccatttctttcttactggattgccaatttctcagagaattaaacatttagtgcccaataagatattttcctatgctgaacacacatagaaatgtatgcttaaaccccaggggctccgttagagtacactccaagcctactcctgctcattttctgatggaggtggtgtcttggtggttggtgagaggaaagataatggctgaagtgtttctctgaaagtggaagatggagagaagcagagtctgttgtaaggaggaaggttaaaattgggcgcaggaggaaacataagccctccgagctgattgggtttacctagacacaatttacagagccttggaagaaattcattcctgacagtgattgccatccttcaccacttcttatggaatcagactcgcacttgaaagttctctcttcttctcagcatggctgcttgagagaatcgggtcatttgtaagtcaaaatttccgcagaatttaaaataggtaaatttgcaggtatggaactttaactggctgagaggatgggctcaattgaaggcagagttcctcatttcctggccgagtattgcctttgagggcttctcatctcacagcaacaaaggtgcagtggacagaggatgaaccttccattaatataagtcagtgaagtcttgattctctcagaattcacaccggatgcggccatctttgtgttatctgtgggttgtctgggaattcagacttacagtcttactggaaatacattgtaaattccagtttccagggccactaagtgaattgggatcccaccccgacccaatggccaaccagtaagctccccagtatcatggtgttatgagccagccggggctgtgagtcagcaggacttggacaaggatctcagaagtttcatctctagcagtcaggacagaaaggatgtgctggcttgcaagatacctctgctcccatgcctgtctgtagagagtcagctgtgaaagtctttatggtggcaggttttgtgagctttgaatctgttactgatgacaaggagacagtaattgaaagatcatgccctcttcatttaagaatgccttgattagtaagatgcactagcaacttaatacctgcgttttgggcaagattggggtgagagtacatgctattaaatatatattaaaatatgcagagtgtgaactagactgcaatttcacaatcactgtatattggaaaatgtgtgactcttcgaattgagtttaactacataatgatatggtgcttcacataaattagctcatttaatcttcacgacacctctacctgtgaacaggtgccccagtcttcccattttactggagagagaatcgaggcttacagacgtattgcataactcttccaaatgcacgacagtccagtgctgccagtcagggggtgagagcaggattagaagttttgttttcgaatgcacctcagacactctattgaaagccaaggccagactttcttccacttccttccttctcattgtctcttaatcagggttctgggacctctgaatggcaacagatagcacaaatgccaacacagtgcactgcaaggagacacctgacttggggagtatctaagaatgaaattgaacattagaccccctcacttgccccgagattctgggactgtgttctttgatactgtaaaggctgagcatgagacatacatacagcgagtgaccaagccaaggagagggctccggacaccaagcaggggccacttattcagtttgttttcatgtgtctgagtgttttcttgagtgtgtgtaggggtaccacaatgggcctggtacctgtagagatcaggatggggaattgtctcccctggtcctgatgttgtagacaattgtgagctgccatgtgagtgctgggaatggagcctgagctctctgtaagagcagcaaaagcttttaactcctgagacatctctttagcctcctacttctcagtggttgtatgtgtacatgtgtgtatgtgtgtgtctatgtgtatgtttgtacctgtatgtgtatatatttgtgtgtgtatgtgtgtatatttgtgtgtgtgtgtgtagttgaagacaaccatgagtgtcctttttctctggtaccatatgtatcattttgagacagagcttctccttggtttgaagcttgtcaattagggtagattgtctggacataaagcaccaggccctgatctatctctgcttctccagtgctgggatcacaaacatgtgtgcacccacctgtattgtttgtgtgtgcttctagacacaaatccacatcctcatgcacacactgcaagcactactctctctctctctctctctctctctctctctctctctctctctctctctctctctctcatctccaggaattctttttccttgttgcatacagcttttgaaaaaagaatctttttattggagctgctcgttgctaggggtaagggagaaggcctgggagagctttccagttcagagctctcagtgctgatttgagtctacaagctcagtggaagcagaccagggtggggagactactgagtcctcccatagcgagacccgcctgagtttttgagctagcccctctagcacagacctgctcatctggtctggacctctgcattctacagtgctccccacctccccaagtcttgagctccttgtgaggaagggaaacagaggcgcttactcactgcattccagaacaatccgggtaatggaaagtacaaaaacaacttaaacttgtttccaaagctacatgagttatgccgacttctcagaaattgtccatttggacccaaaaagtgaaataccattttgaggctcactggagaggagtccaaaggtgacacagctgcaagctctgggcagatgagaaacacagatgctgcaattagccacctcagtgagtcaaagcagcaggcacagtggaattccctcccccaccccaaacacacacacacacacacacacacacacacacacacacacacacacacacacacacacaagtgctttaaaacaggagctctttggggactttaagaataaagggttaacaactcctgcagcatggggctggtgttaaaagcatgagatttttaaaacaggggtggggagaataaatggtagcaataaggcagagaaggggtatccctgagtttgatcacagctccctgcatcttgtcacagtttaaaaattcctgtattttagcacacagtcacaatggcaatactaagcctgctttaaaataacctactggctgtcctatgcaggaaggccaacgtagagctggaactaataaaagtgtgtgtgtgtgtgtgtgtgtgtgtgtgtatgtgtgtgtgtgagtgtgtgtactcccaaagtggagaggaccaggtaatgatttggggtgcaaatgtgcaaattccctgggtgctgctaggttaggtgtgcaggaaaatctttgcccaggccagtctctgccttagctatgcagtctcttccccttctcccatataaagtggggcacctagtttggttgtgagttcaagaccattgagagatggacacagaaaagagtgctgaggggtttgttggctctttgtcaaggaatgacagagctcaaattggatgcacttaggacagttgttgttctggcctataactcagtaggtatgtgatttattaacatgtatgcatctggtcaaacacccttcctgattatagtaagtttgcaatagagtgctacccttcatttcaataagctcttcagaaccctggtggtcagacaggactctggaagtattcatggacattcttctctttgttgacaagtgatctctagtttagcaggacacactaggttatagttagcataattaatgagtctactttgggtgcaacaggccaattttcaggtttattagcttctagagcttaccatatgaagaagagcctggctaaaaacccattgggatgaatactaatcactgcctctgagttcaccatcccatttgctgttggtgcaggactcctgtgtgcattggtgtgagggtcagcccacacagagatgtcttcacttgggtgtccctcatggaatgtgcgtaggagaaatgaagcagtcagtgtcacataccttcccttctctcctggttctgttcatatcttgggactaaagaagctcaggtagaggatagcatctgggcagaagaggatgtgccttgttgttcccagtctgtcttcacataggtacaggctgtctcatttctcccatctgctttaaagagcaagcagattaatgaggagtgtacttagagccttggtagccttgcctccagatatgtgtgtagcatctcgcagtttacaaactaggttcccaaactaatctcttttgacttaatgagacagtgattcaactggttataaatcagcaaagcagtgctatgcaccgtgcatgacaaccacagagccagagcgaagctgtcactcgaatgaaaggaagcgataaagacttgtgttccccagcaggagaaagaaaacagcagttaagttttcattcaggatctggtatcagcctttagtgttttaacatgctcctattgaaagtgcctgagaatgcttactgtaccctgcaggtgaaatgccagggctctggactgtgtggggtttggtgaggtgttgccacttggtgagtctgtgttcttacagcatgagagagttgcactgagtcctggctttgctgtactctggagaacaccaggaggctcttgttctttacctccttactcacagatattccagaattccagctgggcctccttcacaaagatgaggtcttcagcctttacaagtggggtgattggaatcttgtggcttctgctggaaactcctggatgctgagagaggaaagcacagagagagctttgttcttgttcacatcccatacttgtctctgccggtctaaaccccaccatcatgtaggtaggaaggcctctcatctctttcctctatagcaccatgtcacctgcttgacatgtgggactaacacacgatctaggcaggcaagccattctgctgtgtgcagagccatggtgctgaattccataccacagctgacagggatgacaaactcttctccctttatccagccacaggtgaggcctgctgctcatcaggttctcccagagttacggtaccatagaaagtctgcacagtcagtcaggaggttggggacttgccactgaggcaggcccaactgaacgtccccctcttgtcatgtgaaataggctgcttccaaaggggtgcttcaccgttagcacccagcctgtgctataagatatcactaggagctctgtaacttacaacacaaactcagtttgtagcgttggagtcagaatcctcccagcagtctctgggcgattccaggaatctgtttcctcacatttcctggctctcagagaccacctgcaattttgtccttagcatctttctgtgtcactctgacctctgatcctgccatcttgctgccttttctgactttaaaccacatgcctccttctcaaataggccctgctattcagctctctcggatcctccagaatggccccctctacccccaaactgaagatgcttagcttaattttccagcagagactctttgccataaattgtagcagtcacttgcaaaagaaccttgttgaagtggtttgtattagttcataaatggagcagcctctctctccgctgtgaaatagaccatgctcaactgagccaggtagccaaagtggactcctactcagagaaggactcaaaagagtagaggggaaaacagaagctgatgggttggttctgtaacagctgccttctctgtatggttaaaagcatccgagactttttgatcattatggctcaaatggactgggcctcctctgattagcatctgtcaatctcctgggtttttgtttgtttgacacagaccccacattcaaattcatttgatttatgatgtctgcaaggagtggtccattcctctctgctttgcttagccttgttttccagaaagtctgtttagtagctgcttggtgtcttggggcacttggctcactgttttaaataacgggttttaagagatgagggatgtgcttatatgaatggaaaagaaactgttgaatagctaaaaataccattttatcttatttctagggctgcatgcatgtcctgtttcctggaggttaaaactgttaagaatttgaggtattctcaatggagggcatgcacagacaagcttatgactcacatgtacatgcatttatatatttgcatagatttttcattttaaaaacaaatgataatttggagctggagagatggctgaattgttaagagtatttgctgctcctgctgggatctgggtttagttcccagcattaatatgctaacttacaagtatctgtaactacagttcctgtggctccagcatcttcttctcgcctctgtaggcactaggcatacatacaataggcttatatgcatacattcatgagattcatacacataaaataaaaacaaatcatttataaaacccacaaatgatagcttgttttgctcctgctgtatctcccggtgacctgttgggaccagggtcagtgtacccactcgtgccaacatctatgcaatcttagcttcagtattctgggatgcaagagtccatttactggtggtagagttgtgtccagacaaattcatcacatataagaaatatgaaagacaaaaaatgcagttaacatacgtgttactgaccatcatggttcatctacacaacacactatagtgtgtttccctttgtcattggtagaggatgagtgattgcgacttggatgttctgtccagcattgtgagaaaatattcctcatatagatctcatatgctagggatagagccaggttcagagtttgatggctggttctggcaaatgggataaatatagctttagcatctgagaaatgcaaccagagtcatagaaactcgggacatttgtgtatgtagctggctcttataagctttaattaaatgccatttctaacctctagctgttcttaacagcacagtcttcttttatttgtcttgacatatacatgtcactgtatgtgacatgtatgtgacatatacatgtcactgtatgtgtgggaaaatgctcaggggcatcattggatcccagactatgttggtatcatgctttttcttctctatttctgtgtgcgcatgtgtgcacctgcgtaagtccatatgtgtgcacatgtgagtgtgcatccttgtgtagttgtatgtatacatttctgcatgtgtgtgggtatatgtgtgtgttttggggtgcatgtgcatgagggtgcatatgcatacagaggcccaaggttgctattagaaattatctttactatctatttcctttatttaattaagcagacttcctcagtcaaacccagaacttgtccatatggtcagtttcactcacttgctttctctgtggattatctgcctcttcctcctgaggctaggattataaacaggctgccactgctgcccatcagttattgggttctagagatcttgactccagtcctcaggcatgtgctgtaaatgcttccgttattgagccatctccccaactcctaaatgatacactttggtggcagtttctaccttcatgccttattcagcagtgtccagtataccagtcactgattgtccccaggcatcttgtcatatatcagacttagctactttgccttctaggaactagctaacagctggaggtatagaactagggttgcaggtaaccctactgggttagccactgcagacccataaccagagttgcaactaagacctgtacattgactaacattcattagattgtaggtcccaagatactatgtcacaggctaggaacactcaccataccatgtttctttgtctctctgagtcacagaatgggacaggacagagacttggattgaagcattgtggtggtggcactgtgctgggtcagatagacctaacagaggtattccattggcagggagattgcagccatgtttgctggggccagactgcttctatgtgacacagctattgtttgtgaaagagatttgatgcttcattagagaaaagttgtgtacagaaccctggcagagatatcttaacagccttctgattaaaggtgcaaacaaggcaagtgccagatgagctgcatctctggaaagaaggctctacagagagcatattactatttttttctctccttccttatatggcagcatacatttgttacttagaaaacaggagaaagggcctgggtgatgtagcaaagtaggtgtagaaagcagagtaaaatctgaagctgtgcatctctctagtggcctggcaggatatgttgaggtttctttgtagaatatatttgactctcagtctggagcacacagtatgttgcctcacaatgcaaggctttgctggtgtatgagtctgcttgacaagaagcccatagagtactagctggccctggaaagttcaaggccaccatgcacacaaatagttaccactctttttctttgacttcgggactttattaccactgatataatctcataaaaccatacctcaaaagctgttgcttatcgtcttggtctctgtatatggtaatgaggaggtgggttagttctctcctgagtaaggtgattgccctgaacctgggagagtaggactgaaaacctttgtctatggacaaagaagaaaactcactatacgctgatcaaagtgatatttgaagatttcaatgaagggctggtgcatagttcagtcagtaaaacttagtaagcttgcttagtaagcatactggatgtggtggtatgagattataatctcagccctggggaggtggagacagaagggttcctggggctcagtagccagtcagtaaagtccagcccaagagaagaatctgtttcaaaggaggtgaccggcgttcctgaggatggcacctgagataatctggtacacatagacacacatatgaaaagtgtcagttagatgtggcctggtagaccaggcctataatcatagctgctaaggaggttgaggcaggaagatcacaagcttagtgcctgcatggaatgcagtctgttcaaggtcagcagcataatgaggccctcattcaaataaaattaaaaggctaggattaaaactcaggaataaagtgattacctaatatccacaagactctaatattataagtccaaaaagactcaaacgtcagtcaagtcaatggtaaattcctgatgtcctgccatattttaaccccgccctagtatcccatttcattaacacactgcttagcttctcattgcctgtgcccccccccctcgtgttggctggcttacaggttagctctgcctggggacctggggtcctgctgcattgtaatgctcaagccctggcctgccgtatgtgaattccattgtggtctccgatttcagccatctgggatgtcccctagtcatgaaacaacttgtccctccccactgttcatgtgaccagagtactgatttccttcatatcctcattgtctgtagttccaagaaactattgcttgcttatttgctttcttcatcatctgtcacatttttgtacaagtgtcagtttcagaaggtagggatctggttggatttatttagtacctatagaactcaggttccagctagtaaaaccaggcagttccagagagagactgtcagaggagagctaggcaaccttgcttaggaggagtaaaaacccaaataggacaccataagtcttattaggagaagggctggagctcaaatttcagaaatgggggtggggtggattctggaagagaccaattactgccaaaaaagggagagaggtaggctgcctcaagctcttccctttcttttgggggccaccaccactgactgaaccaaagtgaacagttggcaagagtacctcagaaacagctcttgtggtttaaactctcaagtcaagagccagatcaggtggtaggggaccagtatgaggaccgtctaatgactggaacttcatctccagcttcactcacagtcactggaaaacaatagttctgagaaagtaagaggtttgatttttattattcaagacaatgtctcatatacacagactgatctttaactctctatggaaccaaagatgaccttaaactacttccatcccttgtgtgctgggattataggcatggaccaccacacttttatgtggttccaaaagtcatatccagtgccttcttgcatgtgccaggcaagtgcgctaccaactcagctgcattctgacatccttagtgagcaaccacagaatggatgaagacatgggacacacctgctctgagtcaattccaatgtcagctcttacaaaggacccacactatctcaacagtgacactccagacacaaccccctgcccccaagttctgagtgtcaggttctgtagtaacatgcttttgagctagccggctgagagcttagtgtacctcctggctcttcttcccggaggagagagaaggagtcttatttctggaaatactgctgtgtcatgagctctttcatccgatctcagtgatgcttttatatgagcaggattgtgttccttaagggattcctttgaagacagttttaaacttgcattccttggttcagtttcaaaatttgcaacatttgggaatcttccaaaagcccaggattttatatccttgaagtcagggtgttaagggaggaaggcaactgggaatgaaccccaatccatgtttctagacattcttatctgggggctccaagataagaataaagaataagaagccacatacaggcttctggacttattcataaggtggaaataagagcaccgagccttcagtgtgaaatgaatgaaaacacctaagcaaagcgaaagcacattgattgatgcacttgaaagtggtcattctttgcccccaaatcaccagaaaaaaggtcaggggccccacccctaggtaccaatagtatctcaccccgttctctgcatgtgtggtggctcacttttggctgatgctccttcatgatgcccttgattggagtaaaggagactgctgacattttcggatatagctctttcatctggtgacactttgcccctctaaaggagcaaatgcagattttcccgtgaattttcccataaggcttgtttgcattaaaaaaaaaaaccctgttatctgcttcaatgtcatttatagaaaatgtacttttcttttttcctcttcaaccctttatactatggtacatatattgggtacctacacagggagctttgcatataagggttgaacattgagaagtgatagtttttcctgtttaaatgttaggtttcattggtgctctatcaaagctttgtaagtaccatttattatcgggaatctcagcaggttagagcccagagacttcaatggaaacctctaatggcacaatgacaccagcctgtaattaaggcatttcttgggaagtaattcaattgagttatagaagtgaaggtaacagcctgtgggactggaggtaaaattaggagcaatgaatgtgattgaaaggcaagaggaatgttcctggctggagttgtgtgtgtgtgtgtgtgtgtgtgtgtgtgtgtgtgtgtgtgtgtgtactcgaatgtgcatgtgtgtacatgtgcatgcatgtgtgtgcatgctccgatgagtgtccctgagttcttgtccacattattaatatgacagtggggtaggtgaaggactccttttaaagaatgccgtgtgtctggcagatatgctgtgtattgaatctctagacctttctatcagctgtcctggacagcctcaggagacactggtgagaaaagcgatacacctttcaagtcagttaaactctcccctgcagatcccaggaccacgttcaatcaagcttaggatggcacccccttctcggtctttcaaaaggactggttgagtatctttgttccctgcatcttcaaaggcagagccattgagccattcttcagaggcaccaacagagccaccggaaagtggaatttcccacaagaccacagtctcatcaggcttcactcatgaccttagtccttgcagttttgaaggacaaatttgtcctatttagagagttggtggaaaatagccgatgctcaactgtgggcctttgcacttgaataactgcattggaataaatgtataggaagatgtaatcttcttttagaggcccctttccatatgcacagatactaaggttcaagggcagtggctgtctggccagagagtgggtagtacagaccttgggctgtttgtccttgaataggaaggtacagactaatctgacttcttgtggcctcactaccacacctctgccctcctccatgccctttgcattttaaaaccactttactatgtcattgcatctaacctctacctcggctgcatccctttaaaaccctgaatatctcatccatagtgttctaaatgttaagtaattttaaaaacaccaacaagagcagagagctcatttatgggctttttaagtgttttcatttttttttttttaaattgttaagcagtcaagagtgacttgtgggatttttctttattttttgtttgtttgtttagtaagccagtttgtgtcatttagcatatctgtgtgtgctcatggcctccaccatgatcagcatgtaatcgttgaatgctccctctaccctccagactctaatctctggcaaccatacaccactatagttttgtcttttagagaatttcagtagaatgttgttgcatgcctgaagtactagcacccagggtctcggaattgtggctttgagggcagcttggcgacataatggtagttaatatttgttcaataaaatgaacacgtagaaactccaaaggtcaaataactagaggtcataatatgtgaccctttgaggctagcttcttctatgggtatttgtttgtattttgggtgctaaaatccatgcttaagagaatcagtaaaatttatccacctggtggcagaaattggaaaagatgtactagaatacttgctgggcactgggcacagtgggcatggggggattaagggagtgggagaaaacccaagtcccaccagagttccggtgctctgggcaggcagatgcaggagtactgccggccacatgctttccacacagccccaggtgggtgtctggctgtgggaagctatggacccagcccgcgggggctggacaaggggcggtccaaggtctctgggcctcacggaggccagagataacaggttctcggtctcagtctcgagcatcccagacaccgctggacaccgcggaagagctgagaacaaaatgggggccccgggggtggctcagtcattcccagggatgaagggaggagagggggtgctgggtggttcccacgtgggcgagagtccttggtctggtccatggctggagtgcaggaaggccttctggctcatggctctttagtggaaagcctatcccatcgttcaagtgtggcatgccttgatgaacagagacagtcaatggttttagggctttattgtatatagaaagacagagagaaagaaagagagaggccaaccatggccatgtggagagagggaggaagggagagagagaaggagagctagagatgagagtattgagatcttaaagagcgagaagaagccaagcagccccttttatactgggctggactactttgctgttgccaggtaactgtagggaggcgcatacctagctttagtcagataactatgggggtggggtctagccagaatgcctggagcttggggctttatctatgtgacttatagtcacagaattatggagttgggggctctgtggtgtcaggcaccagtctctggggacatggctcactgttccatcccttgtagagtttcctactgggtctccggaacaagcctcattcaaccaaaacaggctgcttttcacggccccacaaatattcatgttgggccacgtgttttattgtgaagaaaaatgtttatgtgatatgtgttttaaagattttatgtaaagtcccttctatttatactctcaaactgtgtctgctagttctgttccatgtcgaaatagcatacattaaactataacaaagggagccttgaaaattctctagatcaagccttggttagatttgctgtttctacatttagaacagtagacatcctttgaggtcctgtgtattgggtcattgtttgttgtttttctcaagcttaggaaagtttggatggcttcttaaatgacaccttttctccctccaagacttgactcttagatcttcctttatttctgtcctagatactgacacctagtggtccctggtaactttgccactgcccagtcttacctgagtacagttggccgacttatacacacagggaggccagctggggttccagatgtctgttgataatcagcatttggaactccgtgatgcttgctggaacctggacatcctctcacactttcagggcatctcagcctttgggagaatagagctatctgcattagtataggagacagattggcttgaggtggaaacagacctgtttcagtgagcttcgtctgccacagaggtaattgggagaacagatctggggatctctgtctgacagccaccagaaggcctcccagggagctggaagagataaatctgtcacctcatttcctgctgcttcaggtttagggctgtcactgctgccaagcatggatttggttctcttccctacccccccccccaaagaaaaaaagaatgggtaactggttctttctcaaagcatggaggagtcattgactccaaggctatgtccaggaatggacacatgtcacttcatctttgactaacagtaatcatcctatactcattattgagatacaaactcaaatgtattatgaaactgtatttctttgcctctctagaaagcttgttgtacagtcagaatagccctttgtttaaagcttcagattatcttttgttggttagtcaatgtactacaacaagtagttgttccgagtcactcttttaattgtgcatgtacacacacacacacacacacacacacacacacacacacgtatactcataaacatctgtgatattgtatatatatgtgtgtgtgtgtgtgtatggaagccagaagcttatgtcaagtgtcttcctcagtcactctctgtcttaatctttgagacagtctcttcactgtacctgaaactcaccaactcggctaactggctgaccagtgagttctgaagatatccctatctctaactgccatgcctggctcttatgttgcttctgggaacttgaattcagggcttcatgcttctgtggcaagcactttatcaactgaaccatattttcatgatgtcctattgagtatcactagattctgagggtgcacttgttggagagcatttctagacactcgtcaagatatctgcttgactaatgtgactgggtgaatcttggctccattgccaaccttcctgagtgctgccctccctgatttgttaaatgggaataacaatcatatgtcccccatttggcttactataagatcaaatgagtcgacaaatgtacatcaggcaacgagccaataccagacctttcttagaagctaacttgggagactccagatttgaccacaactactatgttgtcctgttcaggttgagaactgatggacattggagggaggatgtctgtaggataaaaagtgaggtctgtgaaagctaagcgatatgcccagaggtctctaggcctggagtattcccttgattccttacctgtttcttcatactgcagagcaggccgattagcttcatggaccatcttctcttggacactctgttgactttacagtctttattaacttgaactctcctgccttgccccgacaacagtaattacatgtttgatcaacacaaccacagattgctagagagaaacattgcttgtttttagatggagtttgtgcgttgaccatatttctgctgtgttcatttatctgcatgatacccctgtcttcagaagagacattctcttaactggaccacatgttttgcaggagctatccattgcccagtgggggagtgataacagacttctttgttacttggtcactggccagttcatccaagccattttgttttcccctgttgggcctttctgtcaaattgtccccatgactaacaacctggcttagtggtgacaagtttgttaatagagagctgaagataaggcagtggtgactccctttgctttgagagcttgctgcccacacaatgagtgatccaaggacctgtcatccatttgagccaacacatgcgaggtgctagaagatgagaggactgagagcctcctgcttttgtacgtgtgctgggctcggtgcccccgccccaggaaacctctgactccttgcatattatcctcttgttgactctgtctaggaaaaaatgtgattcagtgatatatttttgtgtatgctcagaggacattttgagttttgccttttgctcagtccacaggccaggtaaggatttccatttgtccatatgaatcaactgctgtccaactgagcatctgaaattggtttctcctgtcacctatcgccttcctggactaggcattgtcacatgcttttgctagggcagatatgacaggtagaggaggtggggtgggattcagttagcgccagtgcctctgtggataggtagcctacactgacttggcacaaagctccattaatatgaggaatgttcttggggtgtatacattctgcttctaagtaacccgtgaaagacactcatctctttgtgtgcacgtgtaggggagattctggattcacagggttccagaacatctcccttcatctttgtttccaatcattttactggagcagtgcaaagcccaagcatgagtaaatgggtgtggtgctgtgtgattcagatctgcagagcaggctgattttgatgcagaccgtgaccctccccctgtctacctcggggatggggatggggacagggacggggacactcctttaaaatgaatatggcatttgcacaggatgaaggccagagcacagaatgaaatgtgactacctgtctttactaacccttaggcagtggtgttgctcatctagggtgtttaaagaacacgtgcatgcatttataaacagagatggaaagtgtgagatgctatgttggaaacctaatgtcacaggggtggtctgggaaaggaagcctggagcctgagttaccctcaagtgcacaccattcaccattaaactggcaaagattcactgacaaactagtaacattgggacttgtggctggtgggaattataagcaggtgaactccgtggattccagtgtctcactctgtagtttcagaagtgaatgaattgggagccttccttacagatgtttcaggagtattcttgagtatctagaactgcaatggaagccactcaaggtgacactatggaaggttaccaggggcatgtggcatgatttgcggtggtgccctgacctagagtttgatgacaccatcttatgtgatgagaagcttgtgtctctatttgaattttcctgactacaggggcatagttgccttgaaggtctacaagtcattactgtctttctcaacatggagaatcagcctcaagcccaaggctctgtgtcttgatgaggctacagtctagagatagaatcttactgatttgagttttcttcactgctgtatatttggggttattctccagttatagcaagcaagatgacctgtctatctgatagcaatagaaaattccactcaaaacaaaattagaaggaaaatattctccatgattaagtgtgcgggaagaaactcattgtaagtgtgttttcggggtaggaggtgtgtgacatctggtaggaggccatgatggtcatgagattttagggggataagagctgatttctccctcaagctgtgagcctcaacaactaactgtccccagtagggcacatttctaagtaagcactttgtatgcatcttgtttaatcattgggcaagcacaatgagatgtatattgtaccagtcaccttattttcaaggtaaacttacttttccaatgtcacatgaccattgaggaacagaaccagtgtgtactcacaagcaatgtgagctctcatcctggcactcctctgtcaccaggacatagggcagaagctgctgggaagtgtgctaagagaagacccaagccactccagcttgtttccattggcaacttgagagagtagtgagggaaaagaacaaaactgtgttaaaggaaagagggccgtggagctagatcatttggcaagcaaatgcttgtcttccaagtatgataacctgagtcaaatccccagaacccacataaaaaatgttggctgtgatgccatacactcccccaccccagtgctgagaaggtagagatgggaagatccctgagactcactggtcaccctaattggctaatgaaagaggtacaaagtgttcctgaagccatttctacatgcaggtgctcatgcttacacacacacacacacacacacacacacacacacacacacacacacggaaaattgtcctgtaagcatgcatgtgcacatatttttttttaacaagaagaaagaaaaagcttcacaccaccttatactcaggtgattgagcccaagaccaatccctgagtgacatccgattcttatctccatgtcagtgttccctccctcctccctgcctattgaaaaatcagtccattccctggaatcctcagtgaactcattacatggagatgaaattttattactctctcctgcacagtctgtatacctagagcccctgggcttggaaaacagttggctcaggtatgcatcaacatttatctgttgataggaatgctttttttttttaatcaaccatgttctcccctattcactatgttgtagattgtagaatatatacttcctatgaatacactcatattcagctaagccaaatgtatttattccttaatttaaaaactttactgagttaattccaagacagtcagattattacttaaattggtggatcttattaaacctctgagaacataattaactcattcattctacaagttgttaaagcatcctgaaattcatgataaatgaggccacttaaaaccaattcatgagacagcaggaacatattcggtatgccatgcctattctctgatagtgtgagaaataaatcaatgtttatcatgagctattataattctaatttaaggattctttagaaggcaattacagatggttgtgggaaaataatgcaggtatttcattcaatttttcccctagcataacagtatctcctgaaggtttcagaactgtgcccagtctttcagataaaagtttgggttggttctgctttaattttagcatcataatattcttgtgtcaagcttagcccattttaaggaatgactaactaaggctgtagagctggcttcaaaattaagagcacttgtagcccttagagaggaccaggttttggttctttgcacacataggtggctcacaagcaaacatctgtaactgaagaagggagaacccgatgccctcttctggtctctgtgggaactacatgcatgtgtgtgtcatgatgtacacattcagcaaaaataccctcatgtcccctctttcttctgatcatgtctgaagatcaagcactatttgcaagccactaggaatctttttggttttctccggccctgtgaatcatgtttcctcttattatgtgggctctggtcatgctgtcttttgtccaaatttctaatatactctattttttttttctacactaggtttggcatgcactgttctttgtgtttgtgtctgctgttccctctttctcccatctttctctttgcttggcccccagttcacacatttcacctacccagcacttgccagtcagctactctgacttctccctcattaccaactctgctatcggtctgttctgctccacacttctttcttatttgggttcagacttacactggggtggttattgagtgaatctctagttccctcattataataagttcccccaaagtagctattattgatttccttgttacagctttatccctggtacctttcttaggatccagcacacaagaaagattcacgtatttgtgaaacactaagggttaaggattctcttgagtgtgtcatggctgtcttctccaatgtgaaggatccttctctcaaacatcttccttgaattcttagccaaattacctctgcttttgagtatgagtgtgtctgtacaaccagtatataaagaatctctggaatgtgcttgactttctcaggaacctgaaagagaatggtgtccttgtcaagctgtcatgcccagcaggcaccatattggttaatagtggggccactgaggtttcttgttggcagaaaattgttggctgctggctgaaatggaaatgagtccccatttgcttccccttcttgtccattgagagtcacgtggcttaaagttctaagcagacaattttgggactggtggaagagaaaatatgtgtgttttatggaatatattaggtcaaggagaaagatgggcatctatgggtggcagagactgggtaggcatatactcatctttttccatccatccatcatcaaaacttagaaaatagaaccaacaaactagaaaaaggctgggctttatatttatatgaggcctgtgtgttccaaagtttccaagttttccactatgatttcttccagaaaggagctgtggtcatcactggtctgacctggaaattgggatgctcatctttctagactaaagaatgtatttagcttcagggacttaatgatggtgccatgtatattttttagttacccattagctttgttgatacaggctggaggttgatcaggaccccgccaaggcagaacagatagatacacagctatctcatagaagaagcatcctcgtgttcttcaccacacctagtctacaaataatcccttatctgtttaaccacaggaacttgagcaccgtgatagctagtgagcctattcccagacctgttctcttacgaccttgtacattaaagaggaataggatgtaaggtaatgggggaggaggaggggaatgggaagaaaggctaagtggtagtaattgaaaataagagtgcagtaagggcttaaaaacagaacaaggggcttccctgcctgctcacctgtgccagggtctctccttgggtactggcaatatagttttggatgccctttcaactgtttctatagacatactcactctgaatatctattgtagatgaaatacatcctcagtacatattatagagtatgtactctcccgtgtctggcttttttcttgtagtgtgatttttcagtctatctgcactatagcaagtattagtacttcatttctttgtgttgcccctcagatactcatgcatatccatgtgcctgtgtgtgtgtgtgtgtgtgtgtgtgtgtgtgtgtgtgtgtgtatgtgtatgcacctggaactacctgcttatatacagcagccagaagaaaacatcaggtgacctgttttcttactcactctctcccttatttccttgagacagggcctctacctgaactcagagctcaccattttggctaggcctcctggccaacaagttccgtgtgtctggaatcttcctggcttcacccccagtgctgaagctacaggcaggttatcaactcccttttttaagtacacccaggggtcaaacccaggctcccatgtttgcatggcatatgcattatttacccattgaacagtctccactactcatatactcttgaccctttaaaaagtgtatatggtttcagagtggtcaacatagtctgacattcgtcagtattgtgccttaccgattctctcttgaccctttgaacagtagctgtctctggccaagtgtttttgttatatttctggattctgagtattctatccaaccctactatgtaggattgtatacagttaaacagtgcacaaacatgccaagctaaagacacaagagaggaagggacacaaataccaagtggtaggtaacagagagggactgccttccatctgaaggctaggcataaggcttcatgatggcttgtggcagtcctctgagtggcagccttgccaagcctctggcatggtaaggtcttgagtacaattaacaggtcttttgtttgaatgaagatggaggtggtgacaaattagaagaccaagttagagatagtctctaacctatggagtagatgaggggacacttgcagagttcacactcagagagttatatatctatgcaagcaaggagagttttcaacctctctgtttcttccaacttctatctgagttccaacatctcttgctgctcccacccacatttccaactttggagcatttctgaggtttcattgatgttaaaaaaatatttttcacaaaagggtcaaatcaccagctctagatagcaaagtcaacagatgataaaggttttatcctgttgcttggtcaatgggaaaaccaggaagatatcataattggttaaaaagaacagacatgtagatagattaggaatattgaagtggattggagggaggggaaactgtccctgtaccagcagatgtagtagtggtcaccagaaccactcctgaacagggcagaatttccaagtctataaatagaaattatttgaggtgctatgatctatctctgatacatagatgtgtgaaatgacttctataaagtaagaatcacatagacagaggggtatgacctggcatcttccatggtctcctttctatagcatcatgtgtttctaggagtgagtgacaggtcatacctccagcaaattgggaaacccaggtatccctgttgttccagttgggatactggatatggaagaatttggaaaaaatttaaagggactatagttggtgggattttgaatgaagtagctggcaaatcaatatctggtggaaaacatctcgattttactccatttttataaaagatgttgtaaatttatgtatatgagtttttttcagtatgtttgcatgtgcacccatagaggccagaagagggcatcaaatctagtggcactggactaacagaaagttgtaacctaccatatgggtgctggaaactgaaccctagttctctgtaaaaagagcaagtgcttgtaactgctgtaccatctctctagcccctggactttattctttaatcaccctggcatttcttttacgagctttgggctttctatttatctctttacctctctgagtcagtaaaatacatattttaaatattatttgtaaagttcatttgaggctccctggtgaaaggtaccagttaacagctaggtattattgttaattatctaagccttgccctttaccctcctgtgggagttgggacattcggaaaaagacagcatggccaaccaagaagcagagagtaacaggaagtgaccaggaaaaggataacctcaaagacacccatgctccaaagacacttcctcctcccaaagtttcgatagccttctaaagtcgcaccagtaactgggactgaccattcaaagcctgagcctggtgtagattcaagcaataacaatagttaatgtgatcattattctgagttttgcagagttcacattgtcttcatagacttttcaaactgcccaaaactagtctcaccaacgcttaatggaatatctcagctgtacttactgcagatggcaaaaaaggaggcgtgggttatacagaagagatatgggaatacttctggggccaccttatttagaatggactcttcctattaattacaatggctttcttgggtatattctcactctatgagaaaaagccacttctgtggaaacagatcagaacagatcagaagtgtaatatgctatgtccattggacttgcttcacataagataaacaggcagcagagggatgcgggctcataaatgcaagatctacttttctttctatctgcgatgcattcatgactttactgtctcttagtttccttcctggaatattcttgaacaactcttttgatagccttttgatatttagaaggctattgcagtcttttgaatatgaacttctatcacactaaatcctatattttgtgctttaattgttgtattttgggtggggtgggggcccatgtggcagagagaacaaatttggtcttcacagtgatgattctgtccagaatcctgggttgagactactatattttgcaagagcaaagaattacagaagccttcgagttctgagcacttggtattggctgcctttggggagctggtgctaagactcatttgtatatcacatattgatcaccttgcttgtgttagatagggaatttccccagccagccaacctggccacactttgatctgcttctcaattcctgaggtgtttatcatctagctctgtgcctgatattcccattcagccatacacaatctgataaggttgtctgtgtatctatggagcattcatttgtctcctcatgggcaatgtgtattcttggaaggacagaattacattttaggtttcttttttgtgctttatagcacctagcaggtgtcagagtcacagtaggtgctgagcaaattcttttccaattatctacactcatgccaagttacaaagatagccataaaggcctgcaacagagcatgcaattctatacatattgctaggggataggcgggaggagtacgtggtgctcattttgaatgggaatggccatggtgggatgtgagctgcatgactagctcttggcattgattcatggaaagatataaacctgcagttatttctatgcaaagtaaagatctctggtactttggttttctttggacccttagaaaaaggaaggttcaatatcctgtgtccatgtagacaatgatagaaagaggcacgctaaagaatcagtaccagcaacacactgctgcccattactgtagcagttagggtcaagtgcgggagcatgaacagcttctaggatattgcagaaactcagaggaagatgatggtgccatgtgtctatgccagtgcagtggtgagaagctggcctgaaggctctattttggtagcagagccagttatgtggaaaattgctctgggtctttttaatgactgcagaagtctaaagaataagttccaggatgaatgttatcctcaacttcctggagaccagttgctggtagtagatcttgagtactggtgtttggatcagtcacagcatctctggaactctgacagatggtattgggaaaactactgaggtccccctgtgagtttcactccttttagaattggcatcagacagttagaatatatatttaaaaaaaaaacacaatccattttctagacagttaatcctatccaggcacagccacatcatggagacgtgatcatagaatagcttctatattatgcccgacactgttaagactctgcaatctgaatcccatagaagggtcatctgtttgcaagcagtaacctagaacaaagtcctgagaaaactgggaggatgctatggacttctcatctcccttctgcttccctgaacaaggaaaagccttctcctagagagggcaaaagcaagggcagttggcggagaacatctctgctgacctgcatggagaccccaggaaaaaacagccagccgtgcagctatctggcagctcaggaagagctgggtgaaagtcctaggggtgtgccatttaatggctgtaacgtatagggggaaattaacagacacctgagtttcagttcccttagccactcagtggagatagtgaaaagtttgtggtggttaaatgaggcaacataaataaaatatttagagtagggtttggtataaaaatgtgcactatattttttctctattaatatttgaatctgttatatacttgttatagtcactcatgtatatttattgtgttgttagtatattatcaagctaggtccattcacagccatttggatacccaccctcagtggattcaattctgggttgatactggttccatctgcttaaatgtcggattgatagccctcgtaacaccttgaatccagtacagaagtctactgtttcagttactaactttattacttacttttcctgttgccatggctgaaaacagcaactttggaaaaacaagttttatttcagtctatggtttgaggatctaggtcatcatggtggttgaggtggggagacaggagtgggagacaattgttcccatggcatctacagtcaggaagcagggagagatgagtgctgcagctcagcctgcccctcctgttttactcagtctaggaccctcgcctctggaatggcaccactcacactgcatactgtctgtcctcaattaaccgagtctagaagatgagtcacacacatggctagaggttgttgccctacgtgattctagagcccatcaaactgacaaaatgagtattagccatcacacccatgtcaactgctttctgcaagtattacatggataattacagcaatgaacaattctgagaagcacaatgaggacaaaatccatgtaccttcctgctatgtccctcttttgatggaaatcagtgtgtgtagcatgtctgtaatgtctgcagtttctgtaggtaacttagtgtacatcttggttatctgatcactgtattgtaccatggtacttgtgctcaaataactcattttatattgcaatggccaaagcacaaggacaacaatgcaaggagaaggcagggcacataacacaaaaggacagcataaccgtgggactatgctgcaatgctacaaggaatatgggaagaaccagccatacgaagggctcagcatggtctaagggttgttgagaacctcctttgatgctaaagtgatgctactagacctaccaaacctagatctgtgttgaaacccacatctatgaccccacatctctgatctacaaatcagaggtgctgtttttaaaaagaatctgaagaccaagtggttcaataagttacacagtgccaaattatggtggctgtcaagtatatgtgacatcttcctgaagatgattccatgtgtgtggtgggtttatatggcaaggaaaaggataggctaggcatgcccacttcagcctgtagcaagtaaaaggcaggccctctagacctctggaacttttccttttcatccagtcttcaagtgtctagtgcatactaagacatggtgtaaatacattctgcactgagtgcagttttgcctttacaacacaggcctatggattggtgatcttgacttctcctgatagcattcagtggctttgggatccaaactgtgttactgcttggtgtttggttcctttgcctttgtgaacatatcctcctttgtggactatggatcagagcccagatttttccaagtttcctttcccttgcctcttgcccccagcagctccccaatgctactctggacacagtaacacagtcaaaactgggatccaaaagcaaatcagaaacccatgagcctgcagttggcctagccccttggaggtatcagccttccaagtaggaaggacctccttctatgtggtctgctcagtgatcatccctgaaattcttgagggaaaagcccttccacacctaagcccctccttgcccaggagtcatgccaaagcattggcttggttccaattaacagtgatgtgttagctgcaagggaagcaaggggagtcagttatcagcagtgatggcagggaccatgagaggaaaacaatgagcttgtcccatcctctattcccccttccttctttggttctgtagcagtaagatttgtcatctaatagaaaagaagaagccctatggccattggctcactgaccaaattcactccatttctccggacagtagataattattaaccgcccactctcccctaatgcctggaaaccagcctcccattgtgttcctgggatagtaaaggaagtcaggttagcagccaggtttgcagtggttcatttgcttctgacgcaggcgggctgcttgtgcttggataagacagtgggcttctgccactccgcagccctgctccggtttgttttattgggcaataaattaacccagaacactgccaaggagagacagataaattagggcaacaatcatatttttaacaggaaaattggctttgtttcttggtagcatcatttgaacgatgaacccagttattgtaggttccagtactgcagataggataggatcctgattaagcacatcccagagagggatatgatgggtagtcagaggaacatttaattggtatcttaggtcttggaagaagcctgcatttcagtcatgtgtgatataaattctatctgcattttaggaatattgtgaacgggtcaaggctggttcccctgcacgctataattaggagagtcctacttgaagacttgggagaagtcttttatgatttgaaatggttgttagctgcaaccctgtggtttaataatgacaaaaacagaagtagactctgagaagaggctccctgtttgcgactcaaatcttgaaaagccaagaggaactgtagtcttcagaacttaagaggaaggctggatccctccctgtcttccatcctatctagacttgcagttgtgcctggctcttttgaactcagtgggagatgaggtgggtctttgccttatactgtcagctgcatggcaggagtgggtgtcatttgcttgctctgcagcatcccttgctctgggaatggtgcccaatgagggatcaatatatatgttggaaaatgcaattataaacaggctattttctaccattggttggttactcccttagagcttagtcccacttccaccagctcttcccctcattaatccaacctcattgataagtctctccactctttcctcaattattcctcctctacctcttcttcatcttcttccttcccttcctcctcctctacctccccttattattctttcttattagaaatagacttacttgggtcatattttctgttgtctcaatttgaagttaacatctcatgtattgattttttttaaaaaaaaaaatctattccacagacctttcaggttgatttacaatttttatctatttctctagtcatatgaatgtgaattcaactcattctccaagtataatacatcatccgaatagactcttcttcatataacaagtcgctttttttaaattttagaattattttagaaaatagtttagcattcactggatttttgtggcctgccccccacttcactgcacatgactggtcagtatgtctcatcgctcaagaatccagctttctgagagaaatcaaatttgtgtttgtatgtaactagccatctaattatgtcttagaaaggtagaagagagagtcaggagagaagaaaatttaaaaaggagaaagaaaataaaaacatatgtttagggccatgatttaattcaccgtaagtcttggagaagaaaactacaaagagtttaaagtcagaaaatagggtgtgccctgacgacctcttgagtgcttagacgactgtcctatccaatacaggaagccttctgagcttccttgtctctgtcatttattaagttttcatgtgtttttttttttttcctcttaggagatttagaagaaatgtcagcgctgtgcacagggattgctttattgggaccaatcacttgcagtggaaatgtgtttactaagacaagtgccattttcagcataacgtttgtactcctggcagagaattttaaagatgactcaaaccttttatttttttttttaagcactgccttataattaaagaaatccaattttgatgatttaacattttccattattctttacagttctactcttagacaggaaaacagttgcaaaatagcttcatttaattaggatgagaaatatagcaaacatgcaaatatatacatatatatattatatatatattatatataatatatatgtgtaatataatatatatatatattacacacaaaactacatatatatcgaccttattttaaattattatttgtagagatagcccactatgtgtgaccaagaaaattaatttaaggcctctctctctgttgtactcatttgttggcaagcatggctcttaggttgggcatcaagagtctgtgatactcagcttcaagctgtgacatggaattaagtgggcttagagtctccttggaaaaattagaaatacacagatatatagctaagggtttacaacagattatatggaattgatggctctcaaagtgcaaaatggaaagtgttttgaaatagcaaacaaacagaggcaaaaatccaaaccccagggagagcatttagtgagttatctgttcatttactcaatgattgtacgcactttttacaacattgaactctagatactgggtcctgaggagagagtaaagatggaacagttcaaaaaccactccttagagagtcatcttggcattatacaatagtcaaataaagaagtaaatagagttatgtcagaaaatatgtcagaatataaatcaggggtggacatgtgtggggttaggaaccagctgtatacacctctctgtgtgttcatgtttgtgcatgctcacagctcatatacagcttcaggaaggctataagaacctctggcccgaggtcagtgctgaataagcagaggccacttactcaaaaggtggcatgctcgcctcacactgggggaaagctagcataggttctttgtgcaatgaagaagggcaggcattgcagaacacttcagatgttcaagacatggaactgctgagctctgtttcaaatcagaactcaggtcaagaaaggaattacactgcagatagaaatactgttgcttttttcttttcttcaggtgagagatgttttgagcatcttctgataagatttcaaaaacctcagtacttggcttggcagccatggtgctgtgtatttgtttaactgttttttagccaccttactctgtatcaaacagtgttttgagtgcttcaccagggatcaagagccatcttctcaaattcacgttgctaggacttggtctgttcctgggtcatgctctttggcctgacaacaggaaggagcatccttgttcagagcatggtcacttggactggtataaaggagtcaggaccctttctatttacttatgggctctggaaactgtctgtaagccatgatgaaacattctccatcagactgcaggatatggtagccatagcaacatgggcccgttgagcacttgaaatatgctacagcaactgagttgtttttatttgactttaattcaaacacagtcctgaaaatgaaagtaatacaaactatgcttcctgttagtgtcatttgggcaaagctacttttcatgtgacgggacaattattatgaggtagaataacacagttaaagtgtagtagagtattggatacatgagtgatttctagtatctccttagattttaatattattgctaaaataaaatatttttagtgtattaggttaaattaaaagtattttgagaatgaatattatcttgattttgtttagaatttattttatctttaagtgtgtgtgtgtgtgcgcacatgtaggaatgtcatttgagtaatggtaacaactgaggccagaagaggatgccagagcctttggatctagagttacaggtggttatgaactatcagatgtcagtgcttggaactcaagttcaattctctaggagagcatttttatacgttaaccatggaaccatctccctagcccttatctcttgctttttagatgacaattcagggcgattacgatgacttgaattctatttctgttggaagttcatccgtatagccctgggaaaggggttgagtcgagagggaatccccactgttttgatgccgttgagctgaccttttatgaacctgttctcagtggaccactgtgttcccactgagcttactctggtttctgattctagaaccagcaggtgttgttactgcttgggctttccagatagaatgccaaaagagagttctgtggaaagtctaaggcattacatgtgatgtatgttttgctccagacaatctggagctggccacagtcttttagaccccctcacgtaccttttcctcttgacaatttcatggccatgcttaatgcttgcatggctgttggcagggagcagttgtccatctatcatgatatttgaagacggagcatggtcttattagactatgtatctggtttcagaggttcccagaagcaagagatgacagaactgtgcttgcttgaaagatctcagcagtcagggaacaacagcctgctctaacaacttgggctgctgaaatccaggtggcaggaaatggcccactcactgcaaagttctgactcagtcccaacattcactttggtctgaatctccaggcccagattgtcgttgtcatgatgtcaaggaacagtgtgggcatgtatatagggaagcaaggctcggcttctcatcatctgagctaactggtaacattgctccaacatcatgctatagagacattgagagctgatccttttggacagcccaacccagtcttgtgactgaccctgctcctgttggctgctgtgcgtgtattcatgccttttccaaatgtgtaaccacgtattgcaatttcttgggtgaattttttgggtgggtttctcctctctcttttcctttttacttctctcatcctcttcctatacctccttctcttccatttcctccccctcctcatcctattttgtttttttgagacatctcagttagaacaggctagcctccctctcacagtgcagctgaggctgatcttgaacttttgatcctcttgcttctaccttccaagtttttctagctaggaaaatgccaatgtgtggtcctgcccttagagacactgaccaaattcctatgaggtgaaaaccgggttttacaaacccttaaggtctttcgttgagggtatggtacctccgtatgctcatcatacctccacagcctacttgaagggattggaatacatgatttttttctgggggcaggagggaatgtgtaaacatcttttctatctttcttttgggaaaagctttcagaccccatggtccacaaagctaatggcccttttccagattaatcactggccacataacgtttcactggtggagccaggtatctctatgtgcctgtactctagtctctgagccccaggagggcagtggttatggttcaaaggttccctgctattgaattaaatatttaaatagatcctggtggtacataatgctacccaccccaatgctttatgttcccaaatgaaagacacacacacacacacacacacacacacacacacacacacacacacaacctttatattttgatatgccttaagcagcacagtagttgggccacttcccaacctccacatggttaatccacctccctctcataattccaagttatcacttactacatttaacattctgccttggctgccttggacccagagggctgcccaactgtgccatgctctcctggctccactcttgtcaggcatggtgtctctcctcttcttctccaggcatggcagatctccttcttcctccttcctctctgtcccaagtctggggatcctaaaagtcccacctctgtctgccctgaccagccattggctgccagcatatttatttaccaatcacaaccaactgaggggcagggtccttctgtgtgaattctcttgtgcaaacaattttggggactcaaattaatgtaagaaagcaagcagcaacaccctgctgagtatgcaggtctagtaccaagctgggtgtacagtcactatgcaataaatatatgtttaatgaataaataaacactaaattaaaatgtaacaccttctaggcattgtccagcccatgtacctagactaacagtgactcatagtcaaggcaaagaggactacaaacccgcttcctccccccactcataagatttcaaaacgtctttcaacatgtttctttgttcactaaaaaattgaagtttattagaaagcattcatgggtgatactagagggtgtggtatctcctaatagataactgaaggagattttgtctaaagaacaaatacctaaaattaaccaatttaaaatgtttttgaatctatgtcaaagaaaagcagtgtgtctgccatatccagggatccattccataatcagcttccaaacgctgacaccattgcatacactagcaagattttgctgaaaggacccagatatagctgtctcttgtgagactatgccggggcctaacaaacacagaagtggatgctcacagtcagctattggatggatcacagggctcccaatggaggagctagagaaagtacccaaggatctgaagggatctgcaaccctataggtggaacaacattatgaactagccagtaccccggagctcttgactctagctgcatatgtatcaaaagatggcctagtcggccatcactgaaaagagaggcccattggacaagcaaactttatatgccccagtacaggggaacgccagggccaaaaatatgggaatgggtgggtaggaaagtgggggagagggtatgagggacttttgagatagcattggaaatgtaattgaggaaaatacgtaataaaaaaatgttaaaaattaaaaaaaaagaaaagcagtgtctttaaagaatattttttttccttttatactggattaatttgtaaaacagagtccttggatggacagcaaacacctagccttgaattaggtagaaatgcagattctgggcctgtccagaagctcctaatgggaaagatagaaagaatctggtcatctcctctgagtgggccctccttccaggtcactttcatggagatgtgggtttgagaagccctatcttggggcaggtagcccaaaggagatttggtatgaaaatgttggagtttggtgccctgctgatagagattcaagtttaagttgagtgtagcagggaattcgtgtgtgtgtgtgtgtgtgtgtgtgtgtgtgtgtgtgtgtgtgtgtgtaaatgtgtgagtacaagtgcatgcttaatggtatacaactgtgtatgtgtgctttatgtgagtgtgggcaggtgtgtacatatggatgagtgcaacatgtttacaagcacatgagtgagtatgcatttgtatgtgttttggtatgaatgcacacaggaatgtgtgcttatctccttgttgctcaggaactaataacaagcttccagaagctcccgaagttctcctttctctatctcccatcttatagggggctcactgccattacagatgcacactgctacaccaagttctatataggttctaacagttccaactcagctctacatattggagctaagggctttagtccctgagcagtctcagcatgctggggcctcttcttcatccctacatcccctgtccagtcagccctctagcttgcaatgattagacacttggcaacttcatgcatcgaaggcgtgaagaactgtagggtggtctagaagttcacataaatgagctcttgtacctgatgatcttttagtggatcagatgagggggaaatttcagccctcaggctggggctgtgctgaaacaagcaaccagattgttacaataaggatgtctaccccctaaaaagtgacagctttccctacatctgagtttaaaaccttagaagggaaaaaaaaaaaaaaacaaaaaacaaaacaaaactatgccataaacctgactatattctggtatatttccccctgtcaactatgtcaaggctcttaaacctatgaaataaaaaattcttcacatatcttctgccccctaccttactgatgcccagctctgtgcttcgctcacctgtcaaaagtcctgaggtatgaggtgggtctgaccctgactcacctgcccttcatgtaaatatccttgaaaggatagtaagcggtgttccaccatttcctcctcttgccttctgtctgaaaaagatgcaagaagctgagtgtgtatgtcacctgccatgctctcatctttccacccaaaacacttgccccatacaagtggcatgtgtagtcttttccatgtctgtattgagtcagccagagctcaagcttccctgtgcagttagcatcttctgatccttgatgggtaatgtggattggtgacacagtcccaagaatcagggtgggagatgagactttgatgggttgagggtatcttccctccttcagggcaaacataattgtatatgcccagctgtttgcctctgatttagcttccaatttcccaggctatgggagctgggatttgtgagcagcaagagggttgctctctcttgaagatttctacttcagaaagtgtagcttatctatctaaatttaataataaatacaaaaatatcattttgaaggaggaagagagatgtcagaagtggatgaactagggaagctatcctctggagatctggatttctctctgctgtgtacttgacaaaaggaatggtggagtcattctcagcctagccagcactggccaggactagctcatttgctagggtcagcaggaggctctgaagaggagaaaatcaacagaggcactaatgggccttagtggatgggcacatttgtgatcaggcccagcctggggcaagagggcattttgaaacctattggatgttggcatcgatgtgggatttacttcctagagtacatcaataatctttcttaaaaacaaggccttggatggctaaaattattcctgtagaataacttgaggttatttctagtagtgcctctaatgttccagtaatccatgaaggggctgtgatcatacattactgcaaactggccttgaggaaacatggagaccagatgttctgtgtctgttccatcctcttttggagggatggttatcagtttgtggatcacgcataggattaagggcatggtcttctcagacacagaatcacacttggaatcttaagctacagttaccaaaagacaaaggagcttctgcctctgctcagaaccttgagtctcccctaaacttacaagcagctctgatccctagccatggaccagaaagggagtaaaaaggaaagctgtggacccatgcctgttttgtggctattggaaagtaaattcagcttactaggtaataagatgcaatgtctagggacatgccacttgcatctagtaggtttcttggaggtacccattgcattcaacagtagaaattcttaccagagagtgatcatgtatgtatttttcaatataaatacatttctagattcaacatacagatgctcagaaaagagtaatcaagtatatatgtgtgtatgtgcatatttgcatgatacatgtgtgtttgttcatatgtttgattaattcgtttcagtccttggcaagttaatacatacataactcagtgatagtaagcacatgtaaattatagtcttcgccattatccatgcatagagctctttatcttgttaaatcaaaacttcactctcagttatcaaacaatgattctctgccctcccctgccattcctctgtaacctaataacattccttagtaaccacccttgctatctctttgaacttgactactcaagtgacttctaaggtggaatcctgtgctctgtttgtccatctgtggctggctcctttcatttagcataacaccttcaggcaacctttgtgacattatgtactataggatggatagccttttgtgctggttagttttagccaacttggcacaaactagagtcacctgggaagaggaatcctcagttgaggtatagcttccatctgattggcctgtgtgtgtatctatttgcgttggggagaggggtagatattttcttgactagtgactgatttggaagggcccactgtgggcgatgccactcctggtcaggtggtcctgtgttgtttaagaaagagactgaataaagccatggagaacaaatgagaaggcagtattctttcatggcttctgcttcagttccctcctccaagttcctgccttgacttcccgccatgatgaactgtatgatgaaataaaacatttccccctaacttgcttttggccatggtgttgtttattaaagaaacagaagtaggacgatgcctttattagatactgaaaagcattctaaatgtacatgtatgtcccaacttgtctctttgtgcttctgcctgtggatccttgactgttttgatcttttgccagtcatgaatgagtcccttctaaacccgactggccaaaaatctatttaaatcccttctcaaccccagctttgcctttaatataatctaagagctggcaagatttgagaagtagggcagagaaggctgtaaatgtaatccttggtgacagtgagtggcaagtgttgacctggcagtgctacccatgatttctcatcttataaacctaattaaattaaaaatccagttggccaaacccacactcacttaagccaggcaatttctcacaaaactcattaactaggacttgggagtttcaccaacagatggaagtttcccccatgtttttcaatgattagatagaaaaggaccttcaaacttcagacctcaaatggaagatcttgggttgcttcctgaagcatcggttttaatgcttgttggtaaaattaggcaaaaatgcatccttttaagtattatgaggcaatgacataaaatttcagtgtcattaatctgaggctgtaggaaggacaggaatttaggggacattttctgactcattgttacaattatttttcttcatttcaggtttgtttttttttaaatagttataatagattatcaaaaggaacatattatatgggtaagatgtcataattattggcaaccaaccaggatttcagagcatccctgcatgattggagtcactaacctgcagcagctctcatctgaacctggggctaggtcaaccttcattttgaaggaggaagttgttaggcaattagcttgtaattgatattccagattcttctttggggaacatttaaagcaaaaacaaatccacaccctccacctctgtctgtattagtcatatttatcatatttctctgtgtcctcccacaggcctgctattgccttcattctgtctctcttgcagcagatggatggtctgtaagaaacttgttctgcatagcttatgttaagagggactctcactgtcttctgggctggtcattttgggctgacatgacttataaatggacataggtgcattgctgtgcacatacttgattaataactattgttagctatcaaccacttgagatcattaatgtgtcagtttatctctggcaatgttcatatatgggtatatgctatagatggctataccaattaattcacttattacatatggatgatagttatatttggttgtgtcttgtgatcacagattcctggttttcacccaagtgtattctctgcttcttcatttaatgtgtgctcattaatgtgcttcatttaatgtgctcaccacaacagttgaatctgttttttcctggatgcctaatatctctttcaactgtctctggacctgtcatgcctctttgtagtgagggaccagtaagtgttctttcttccatccttgtttaaaccctttttctcttgagaagtctgtcatccaattaaattctattggtgtctttcgtcctaacaggctatctccctccctccagacccttattgctattctggaaaggtgccgccatccactctaaactatgtacatggcttttcggcatgtacacggtatcctccatcccactcaccccacacactagggtgcacttaatccccactcattggtccctgcgtcctgtgtcacctggagccacatctcatttccatgcaaggttccagattcttgaatctcatccttgcccttccattcttcttctgtttccatgctatttaatctccagatttgttccccatcccctttcctaagtactcatctatttaatgaatactgagagagctgatgcagttgagttcctgccaacaaaggacatgcattctgtcatcagagcacttgcagtccagccttggagagacacaatgatcaaaatacagcaaaaaatcatgttactgctttaatgtggagtgccacaaagagactatatacttgcaggcaattttttatagcaacaggcaggaaataactgtggagttgattgctgatggttacgcaagcctatgagaagtgacacttgtagaagcctagaactggttgtgcaaaggcccagtggtaggaagggctggaagaagtgagtggttaatgacaagatctgaatgtccacagtaattggagtagaaagagggaaggagtcttagatacagctagaagagatggatctgagttttcagtgaattgactctgccggagattattcttttgttccatactagagttatgatttgaagccattggtgtgggtcccttctctgtgtcctaacattccaggtcattcataggttcataggtttacatttgggaaaatcactcatttcccataaatgtgtgtgaaaacctataaaatcttagtaatttctgctcggttattttatgtatgaatttgggaccaggggtatagtttgcttgtagagtgtgtccttagcatactcaatggtggggttctagttccaacactaaataccagtgataacagcaaagtcttatacctgaacgttacatatgaagaaagaagtcgtgttcccaaatgaagcactgtgcttttccagtacagcggctccttaaaggcattgctgtctctggcttattttcttcttgaacacatttctctttcattctttccttggagtttggatgtccactgaaataatttatatcatgtttgtttgcacatatctataaatcaattgcaatgtgtcagactatcagatggtaaatttaagagacctttggctatctaaatgacctggtcaaaacacctcttctatactttataaatcatttaaaatttatgctcacaagagcaccttttgaggtgtcaatatcataccgatttaggagaatcattaaagctttaggaatgaaaaaatgttacttgacagatttgttattaaaacctgctcccccacactttttattttccacaaaacaaaacaaaacaaaacaaaacaaaacactgagatccagtctgagcttcaggtgttaaaatgtagagaaaaagtgcaggcttttcacagatgacaagaagcataagaaaaagaggttggggtagaccctgccttgatttatatagccatggcagaggcctggtcctgggagggagctcttctatagcctctccaagggtcctttctattctgttctgcattagcttgggggctcatgtgctgcgtgagcaatcaatttgggtgccgcagatgcacactgtgaatcagagcatccactgagtccatgcatctgacttgacaagagaagactgagagacacagatgttttgttgggtattgttgtcatcatactgcatcatgtttatacacgagaggtatacaggtggcatataaaagtgctgccttttccagatgaaaatacttcatttataactggtcaggaacctcccaagatcctcccctaataagtttctcttccaatcctagcatttcacagactgggaaactgactcccagggtgatgaaaggtcaggctccatacatctagttcaccaatgctgcctagtgaggccccatgatcctgctgcctctccttgccacttgccattgtactccatacttgcggtctggcctctctagcacaggcccacctggaacatcaggaatattctttgtttctttgtgtgtgtgtgtgtgtgtgtgtgtgtgtgtgtgtgtgtttcacccccattctctcttcctctaccatttatcgggtttgacatggaagcggtggtgttgctatgattggtcctctcaaggagtctgtttatgtgtaagacatttcttagattcataagattcttgattcatttcatctttggattccacacctgctcatggcagcttgactttattattttggtctcccgtttccctgtctcttattctacaccttgcacatcatggtagagaaatgtccaccgagattattacattcactagccccagcattgcaattttgatgttagactgcacacccctctcagaaacaaactgtccccagatggttttgccttgagaatttgcccatgtattttttttctgtacatagttaatttttttatatataaattaatttaaaggaagaaaaaaaaagccacataccttcaagcatcagatagggaaaactgtcctttttccaagaaaagtctctgttgccagtagccagtttctatatagaacatgtaccatcattgattagggtcatttgttctgctgtgagctgaggagaatgtacaaaagcccgcttagaaaagaattaattcctcctcctctccagactttctggagcacgcctagtagattctccaagcctgtgggcctcttacatatgttctaatgggctaattgataaggctacatttgtgaattaatctctgacttgagctaagtggttttccctaatggctttaattcaggaacacccactcatggccacatgtcagatttttgagacaagctgaacaaaaatgaagggccccagctcccctcccattgttttgagtttctctggtaccaggaaggaaccagtgcactccctgttcgtctttattttgttttgcatttatttgggggtattggacatgtgtgcctctgcctgctctgtttctaccttgtgggttccagggatcaaacttaggttgtcagatttggcagtaagtacctatgcttgccaagatatcgcacaaggagactctacctcggctttgtaagaaaactccccagagatatgactcctttgagcttcagctccaggtccatctctgaaggcccatgttttctcatgtgtccattgatgtgactcagcctattactacagtctaagcccagtaccctgcagccctaccagtatgtcaagtaaaatgataagtaatagtgaaaagcagagaagagagttgtatatgaccacactgggaagaggaatgagaaaagaggttaagagacattcccaccccagttcacattcaaggtactgctctgaggattgggcttaaatagaaggcaagaggcaccctggtcaagtgtggtcctgcccatcattgacccattagtgtctgcctccattccatcctacaagatggtctgacaagttgtcagaattgtatgaaatccctctttcctgagacaagctccccctggtctagttggcatcaaaaaaccacagtctttcctgtcacccagcacaagattactggttaaactctaattccttgagggtccatggtgtcagtagtctaagacctgaagtgcatggcttagaatacctttactcctaccatgatggttacaaacctgacaactggagacatttctgcagagctgcttttttttttttttttttttttttggaccttggtgtccgtgttgtccctgaacaaagaattggacaggatatctagatggtagctagcagacagagataatttattaaggaagaatccacatcaagggaggaagtgggctagatcaaagagagtttttgtcataaacagccatgctgtacaaaggatttgcgcttccatattccataatacaggcattttgataataatttggcttttctgtatatattccatctgttacgtgtagttctatgtataactccatgtgtctaatgtctcattagtgtcttaagtctccattcaggagagtgctgttgaatatcaaaatgatgcatgggtaaccttcagacactggagtaccttacctttgcatctgtgctagcagcccattggctgacctcagccacactttctcccagccttcatctttgcccatttgttctttttatatgctaatttctcaggaattgctttatagctttctggccctccctctgtgctctctctgcctgccccaacttcactgaatctgcctttccgcaggagctttggtaactgaagggtataggctaggcttgctcacactgtttctcattttcatgacattttccctcccaggcatttgaaggatcttcatggcttgctaggatttccatccagacaaatggctgctgatgtgccttgctctcatctcaattcatgcctagactcctcctgagaaggaggatggactttttgtgtgtactgttttcacacaccgtctgtgttcctggcattctttggtacaaacacttgtcatgtttcatttcccattctgaaaataaatgaattctgttccattgttccaatgatacttgtcaagctgctccttccttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctccctccctccctccctccctccctctctctctctctctctctctctctctctctctctctctctctctctctcgccctagcactctagaaatagactcaatagtctgggctctagaagcctcaagaaggcaggctcagccatccctccccaatttactcagtgcggccacattgaaaagaggaacagataaaatgatccagttgacccctgtgtctttcagtgatactgacacgaggtttagacttaaatagaggacaagagatgtgtgtgaaaaagcaggacttaaggatggtcctccctatcaccaattcatcttgatctcggctcctgtcctacaaagtggtctgataaggcagtaatctgtcagtcactgtccccactgctgccttgggacctatctggtttcagccagatgataacctttgttctagagctcagcttgaccctcatggctaattgtcctatctggggagtggtccatcttgagaacattagcttcttctagaattcaaggtgattccagacaaaaagttaagggtaaataagttagctcggtatgttcatccaaagtgtggatactaaacagaagcagagatgccaggctctcatccgactttcagttttctcttggatttaagccaggagtgagtgcagtgcactaaaagcagtctctaaattcatatgagtgtttgcagtcagtctgagagcttatataacagtgagtactgtcaaagtgctcagctgagtaccgttcatgaggagttaaacaaactatacagacgctggtgtcatgacagacagacaaggagcaaatgacctcttggattataccaccaaccacatataggcccttgtgtgggaaaggcatggtcattttaaaggttattttatgacttagttgctggagataacatgcatttccctgtcccttggatttctatcttccttaacactggggctttagaagtaggcagggtcttcaggggccctgcactgtactgaaacaatatgagcatagctgtaacttgtacaaagaacagctacttggagaatgaagaaatactgaagcaagaacccatattgtctctactctcctttaactactcctccatctcttgattgatgatctgccttcagtagctttagcatacaatctctgtcccttctttgaacaactgactataattatgtaacagtataggaccccccccccccagtgtgtgtgtgtgtgtgtgtgtgtgtgtgtgtgtgtgtgcacaaatgacaccacaacccagatgtagaagttagagggcagcttcacagagtaggttttcttctactttcagtgggtttgctagacttgctcagccactgcctttacattggccatggttttccttcccaaaaaacaaacaaaaacatttagaatgtattgttttgaaagttggagaaagttggtgagtcatgcccttccactcaggtggctttgagagagccatgtaacaagtggctgagtctgttgggctcacagttttttggccaggtttctgcacaagctgagtctaggctgatagtatagtcaagcctgacatgaacacaaggcacgttagtaactgtaaagtttacatgcacagttcaccttcttactgagtaccactttattattattttatttgcctacatgcacagttcaccttcttactaaatattatttattattattattattactattactattattattttatttgcctacatgcacagtttaccttcttactaaatactgttttattattattgttattactattattgctattattattgttattttatttgcctgttgggaggctcctggtggttgggacagtttgaatttcccaatctctctgagagaaagccttctggcaggtcacaggatccaagccaacaggggctctgtggggaccgtattcctcccgtgttccttttgctattactcttgaagatgctgctgtttgagtttgaagaggccagcagggtgtatttcaaactcttgtcactgatttacttaaataagtgacacataattccaaagtggaagcaactgagacagattagtgttagtgactctggccatcctgtttctgggaaaatactgctttcacagaagtgctgagatcctaacttctcacagaatgtaggtgccatttgcaaggtctctgagtgttcctttcataagacatagcatttggtggcataggactgtttagtgagccctgacagcagctctacattcatacacatggagctaactgggcagggatctgtgcccaatcagtaatttatgaatgaaggggaccctcccctctgctgtcataacaccccttccctctgcagctttctgagaatgaggtcaggaccaggatctaactgcttatggctcagaaatagcatcccagctccaaattaatctgacactgtttgtcgtaggatgaaaagcctgcttatagctttatttccggtatacccttgcacacaagctgtgaatgaacccatgtgaagagcggaagcagaggcgagccagccaagaactagttgattgggtagctggtggttgcagacaaactgcaggagctgtcttgcattcaatgggagccttgatttgaaaagcaaagaggaagaatgaaatataccccagtggtgtagctctctaaccaccactcttgagaaaggagtgctagctattgctgagaacactgtgtgtcccttatgttgtgcccagtcatttctcacactgtgtggctagctgatcacctctctcctgtggttccttgggcggggaggggggcgttcagtgctttaaatgggcattacacatacactgcattttatatcaaccatattaacacgcacagaaaaacagaggagtgtgcaattttctcttacacacagacacacagacacacagacacacagacacacacacacacacacacacacacacacacacactaatgcaccacagcttaataatacttagacttagcagaagtaggggttactctctttccatcattgcaggccagccagatttctgcatatggatcctgaggagagttcacatgtctaagggtcttccctacagtctctttaggagttgtgtatatctaaagggcagggttgagcagcacacaggcattgtgtatggttttgttgtcctttttagtttatttctgtgctcagccttaattgctggctcttagtgtcttttttactgggatcattttttattggcattagtcgtcttctctgcaaaagatgaaataaatcattggaaagttgaatgagggctagaggtgttagtagcagcctgatctgctacaggttccttcagtggacttttatgtgccaggtgtgcattgaaggagatgtcaaagctgtcttttatatttgtgatgattttgaacaagggcaaaaagcttaaagactgtcatataactaaatggtcagatgtatgacctagttgacattttttgcatttaatgttttctctacatgtttgagaaatcttataagcatactcagaattgagcaaatttatattgatataggattgtgtgtgtatgtgtgtgtgtgtgcataaatatttctcttcacatgtacccaaagtggtatctgtagtagccaatgtgcacttttcaaatggatatttcttatgtagagacagaaagcagattagcgactgtctgggcccagaggatacaacagggattaatttcacaagcaagaaagatcttattgtggtgataaaaatgttctgaaactggatcacggtgatgtcaataagttggcaaattttacaaatttattaaagaattatgtgttcaaaatggatgcattttatacctcaacaaatctgttaaaagtgatcgttccctttaaatcctagggtcggtagaggatgaaaaatgtcatccttccaagtcttttaatgctctctttccctgctaaagtttgtttaattcagtggtggagaagctgatcttcaaggtgacagggcaggatcaaaatctaaggacacaggatgggaaagtctgccctgacctctattggcaagaagcaaggttactcccactgctgggtgaggagtcaatgtctgggttgtcacagggcagggagcacatgagcacatgagatgtggaagcagttgttacagccactcagaaatgcaagctttcagctcccagcccttaagtgatggagtgtctcttttcttttgcaggttgtgttagtctttgctctcagcattggtgccctcgtaatatacttcatagactcgtcaaagtgagtatgcatatatgttgtcttgtccgttgtttttcccctagggcaattatgatcccttatattgatgagcttatttaacttaatactagccttaccgagattctcctgagtgctgaagacttgaaggaaggcggggcttccctgtgcttcatttatgaatggggaaagttctctcaaaagaacggctaggttgatactgatggtatggaagggagaggcacttagggaccaaaccttcttgttgggtatacatttgtaatgagctgtttcctgattgagtatttatactgtacatgccaaggggttaagagggctcctttgggagtgtgtaagctctgggagagggtgacagagtccaacatgagcctgagccattctagccacagccataggatccttttctcatccagaaaaatcatattggaagatagattagaaagcccagtgcaaggattctacctgccaaatgaatatgtagctgaatcaatggtcactgtgcttctccaattatgaaactaaagaaatgggataaggcattcatgaggcctcccagagctagaggtctgggactctctgagaacttgtagagagtgatgctcatgaagacccttggagtggcaggttagtgatctggaaccccagggtaagcatggttcacagatgatgaacctttggggaggctgaagagaccaggcaccatggctactcttaatgctgtgggaaccactgctgaatacatcactttttccaactatcttactgaagtctcaaagttgacagcatctgagacacacagatctgggaatagacttgcttttctgctgtgacacaaacttgacagctctggccaaggacaagagcccttgaccttgcagtcctcattgtttactttgggggtggttttcatcgctctaatgttaatcctgcttgggtcttagccttcgaacccagaatacctgtcttgtgttcctgttggatcagactctggtatgcctcaaatttgggctcaatgctctttttcctatggggtggtatggtggcaatttaatgcacacccaaattccgaatttccctgagcaatctggtcaccaggcaggggattttgtacatgtggctataaaggccatactgtcacatcagggaaaagtaaagaaacatatctcttcatccttgtctgaaatctgccactgtcagactgtcagaagtcacctagcccacctcagacacaaggctgggccctcacctgtcttgagccgtgagtcctttaaatgtcctcagggcacaagaatatgcatgctctcttcatctgaaattgctagtcaagaaagaagagtatcattcagtctgcaagtctccagttctgtgagtgaaggtaagctctcttttcatatttatttagagattctggaccacatttgaaatgaactggcactctcaagcacttggtcatctttctccaatctctctccaggggtcatggggtacacaccctgccaacgcctgtgctggggcttaggaaagagtttcggatatgtagtctgtgtgcccccagagagtacacacttatgtgaaggtgagtgtggcggtctgctaaagggacagagatctagactgtgcctccatttcctttgtctccctttctgaccccatgtatgtcatggtaataaactatttctggcagatggatttggatggtgtctttttttaaaattgtgtcaactacgagtcaatttttggctgtgtagagtctggtcttccttgggggaggatggcagagcatcctaggttgttcctaggttgttcacctaggttgacactcttcaccggtgcctccccagcctcctccagccctttggggttagtcctgaaattgctcagtctttgtgaagatgagacttgaaaccctcagtgattctggatcttttaggctcatccaagaagtctgtaccaaggctgatcttcagttctggttttcagtttcccaagccagaaatgccagtactcttggagattcctcattctttatgggggctgaccaagccttagcatggattcagccgttctctccacctaaactatgcagactgtgtgggtcttttttgtaacagacttggtttagcagaacacctgtggctacgtacataactctacttttcattgctgcttcttggtctctctctgagaccacaccctaacactctgatttgtggaaaagctagtgagaagcctatactgagaatccttcaccttcccatccaggttgagcaaatatgctcagtttatagagatgaactaaagtaaaatttacaatgttgttgcctttatgataaatctagaaggtcatagtcagaacaccaaagacaatcccctaatcaaactgcaatcaagcttagtgaatgaaatgagatgaaactctatatataaactacacatggaactagggtgagaaagtataaggcaaattcttgaagtctacctttttcattcaaaactacctctgtctcttaatagacatgacttggctggccatcttggagagcaaattaaattcctcttaaaaattataccaagtcattgccctgtcaaaaatacctggtattctgagatgaatttgctttagtgttaaccctctgcaaataaattggagtgacccttgccagactgacacggtttgcaaaattgttctcttattatatttaaccagcgctgtctttacctacttggtagattggaagtctcatagttagagaagctcaagatgcaaggctttccacatgtggccctttaggcagtgcaaagagggtttggggatatgacctggtgggtaagaacatctacttatgcttatgaggatccgagctcaaatcactaaggggtttctgaaaagctgggcatggtctatgactccagagctttggggggatggagacaggaagaccactggcttgcttggcagccatcttagctgtgggcttagtaagagactccgccttaaaggaataagtcagagggtaagaaagcagggcacctggtcgtctctcttgatctctgcttgcacatatatcacacatgcatatatgagaaagagagagggagagagggagagagggagagagggagagaggagagagagagagagagagagagagagagagagagagagagagagagagagagagagagcaagctacaaagggtgcagatgggcatatgaaacaggtccctgtggttaactcagctagctgatgtcagagaggccgatttagactgtgcacacagacaagcagagtagatgctcattctatctcaatgagccaacagaaaggcagtaaagttcaggttaactttgtgagtggcaggtgtaattataattggtgatgtaccttacctttcaaattttactcaactacggtaatctcacacatctttgcttttcagttcttaatccaagatagatagatcccctagtggatctttctcaatgaggtgtttgactcctttgggtctttattttccttatgtggtctctatgcgaagagtcatttggatcatctgcagtgatcaccatctgtatgagacagcttgtcctggagcctacagataaagagaatcagattaaaaagggttcaaatggagcaccatcattccagtgaaagatgctaggaagattcaaacaaaggaggacattatagcaggacttggttgagatgtctttaatgtcagtgccttccggagacaagtaatcttatcctttcaaaggtccatgttctgcaaattccccacctcctaattctgaccctgactctgcaggtactccttctcctatgcaccctgatttttataacacaaagacttttttaaaaaaaatgtataagcagggtctcagcaggtagaagcatctactacataagcctaacaagtggaacttaatctctggaacccacattttaaaaggcaggagtggtgatgtgcttctttaaaactggcattcctgtggtgagacgggaggcagagacaggagaatcctctaatagcacatgggccagttggtcaaaacacgagaaacaagggaaactctgcctcagcatgctgcgaggtgagaacatgctcctgaaagttttcttccaacccccacacctgtactgtggcatatatgtttccatacacacacatatgacacacacaaacatatgcacacacacacacacacacacacacacactaaatagtttttaaaattgcgcaaccaagtcaaatgtgcccttcaaggtcctatgaatgtcaatgtcactgttgcttgctcctcctctctcctcgataccagaccaaattctgaatatataaggggtgaaaagaccttatagtgtcagcatgggggtcaggacgcatggatggcacaaggcagcagtccctgctgcttccttctataatttaaaagaaagttggagagacagccgctctcaaagctccgtgcatctgcatttttccagtggtattctgggaaaggatgactcacacgtggggagatatttattcctttgattcatgcttaaatgctgctccttcttatgcttcagttacgtggattatgaatatttaatgctgcatatactggaaatgaaggtcaggtcctgctcactggcaacttcaaagcagcctccattctgaaaggcataccacctgctgttagcagaggaaagcagaaaggttatgcattgttaaaaatcttccttaatgactctatctgcacccaaatgcctggtgcacagttggggctgccttctctggcttttccagcttttgctcttggattcttgtttaaggcttgccgcctgagtgagtagggcatttggatggtcgaggaaaccatagcacaaattttgtagcacttcctgtccaagtgctccaccgccaggggaatgaccacttctcagtcctcataaatttcatttatttgttcattttatattcattcattcactcattcattcatttattcactttcacagcttcaatgtgaaaaccttaaatattttccaggtagtgacagtgcttatggttaaacatagttgcagataattgtacataaatttgcagtagaaactgaccagattgtttccatagcctctggaaacacaagtgactctgttattataattcagaaatccagagccttagcccaatctgttattatttcacagttttaccttccactactcttcatatcttatctgatatctctgctttcatccgataaattttctttctaaagtaaaaaatcaggggattagaagatggctcagtcagcaaaatgcttgccataaaagcacgaggccctgaggtgagcagcaatgcaaaagaactgtgtgtctacagtcccagtgctaggtggtaggtgagacaggtgggtccctagcatcctagccacctctttgaacaccaggttaaagactaatgtctcagagaggaaagtgggaaacaattgaggaacatacttgattttcaacctctagccgctacacatctgagtacatacacccacacagtcagacacatgcatgtaaccacagacacatccacacaaatttgaataataacaaaaggctagaggaaatttgtgtccccattgttgggctgcatgtgaattagaatgctcagcacattacagaaagtattaatggcttcttctaatccctagctggagatttataattcccactttactgactagaagtctggaaccctaaaatttgcttcaaaccatatagctaacaagtcctgaagccagaatctcactctaatgtgccaccagctcccccagtccccgctgtcacttgtaaatgtcaaggaataaacttctagactggagaagttctagaaagagcttggtgctgctttgtcctgtcaagtcctctgccttcttccctttgtcttctctttcccccattctcatcctgagagccaagtgtacaatagatagctcttgggagagccccatcaccatcctgtcccctgcatctgctgtggatcacagggaagttgatggttgtttctcgagagtcctcatacccagcggattctttctaaggaaggagtctccccacccatccctacctgctctgctctgcacacagaagcaggtaggagagatgccttttccctttaattgaatgcattcttttatcctttagagagttgcaaggcttaatcttttatagttttgcattatattgtgtaaaattcacaaatattattaaaacaacagagtataggaaaagtgggcccaaaaacggtttgttggaaggtattaaaaaatgattgaaaagaaaaaaaaacaaactagcctctttctttcattacttttgttctaagtcaccatgcacagatgttgacttggtgcctccaatgtgcccaactgcttggccaaccacttggcagggatgtggagacagcatacatcagggttcccttgtgatcagtggtagctttccctttcaccattatgtagccttgcagcatgagcagctgggcagccagggcattgggagaaagcgcctgggcatatcttagctgttaacttcctttaatggatcagggtcattgtaggtagtgctctgaataattagctccagcaccccaccttcttgctctatttgagaaggcacggcatgcacttaacctttgttgaagaagtcaacacaaatcacggtgcgtgcaaagcatctctttcttctcctcttttaaagatactccccaccacaattttcaccatccctcagtgacatttttattgccaggctttggtttggaaaattatgggtagggaaagttcaagggcagggtgttcagaacagcactgcacatctgtgtgggggaacacaacaggagagccagcagctgttgaaagaatagagtgtcagatggtagaggagctgagccactgagggatggagacgggctgccttcagggtagatgccataaatagctcccaacgggagccttcttttcctttcagaatctagcctctcatggcacctttgaattctgtgatgtgtaaggagcgttgacccagtctttctgcatcatctagtttttcatgttgccattctctcattagtagggataaacttggtagcaaagacaggtagaaatgatacagagggataaaggaggcacattctttacctgtctgcttccatgtggatggatttaggccacagggtctcttctttggttatataacactagattgactttattttttctcaagtgttcctcctcaaccttccatagcactaagacagtctctgtcctcactcatccctcactgtgcaagtggtcccataggtaccatgataagatggcatcttcaagtgttaaagagtgtgaatgttcctcaggcagcttattagaaactataggggactctactgggagtgagaggagtgaatgagatagacctttcaggtttgatagcaaagacaacttgggaatagagttctcttctatatctgaggagtcaaccaactgtggattgaaaatattgtctaagaagatcccagttttacagctcatacatagatatattttgttttcattactctctgcacaacagttgctactagtacaacattgacattgtattaaatattatttataatctagagaatgtaacgtataaggaaggatatatctaagttatatgcaaatgtgtcgtttcagataagcaacttgaaggtacgtggatttgggtattcatagggaccccttgaaccaatttccttgaatacaaggaaatatgttgtcacatcttaaaaatcccttggtaccactaatctctgtgcctgagcatattctcccttaattgcaggtaaacctggcagaaaatataggtggcgaaggtataaggggcagagatgacttctttctatgtcttttacttctccataggtagatgtaaaggacaaggtctgttctttggttgtatgacattaggttgaattcatttgtctctcagagtttcttcttctaccttttagacatgactagaggttaaaagtcacctgctaaaagtcaccaaaggaaagtactatagtcaaaaaataaagccctttgagataaagcccttcctcttgatcttttgtgtcgtttttaccaaatttaagccatgagcaaagatgtcttgtgatttactgtctactaaaaaaaaaaaaaaaaaaaaagcacattgacttttggtgccaattcaagactcttaggtcttcattgaactatagactttcatgccaggagaaagtagatataatcccaggtggagcggtggaaaagattaaactcagacagaaggactttggggccagttagctttgtcttcactggcaagaggccttaaactctttgatcctctctctctgtcttgctctgtctccttttctttcttctctcccttcctccattctatctccctctcctttccttccctccctccctctttctttcctcccttcctcnnnnnnnnnnnnnnnnnnnnnnnnnnnnnnnnnnnnnnnnnnnnnnnnnnnnnnnnnnnnnnnnnnncctccctcccttcctccctccctttcttctttcctttctcccctgtctactccaatctgtccatatgtctttctttcttttcttctttcccctgcccaccccccaccctcacttcagagttggagacgtcagcatgcagctgtattgtggaaagttgacaaggctgggtcattggcttcacttcttggcatttgttaggcattacttttgagaacactgagcccaatggctcatttgctttccctgtgaaaatactatcttctaactatgcctataaatccacattccccgacccttcagaattagagtgggcactttctgaccgcctcaccattttccaggatttagaaggaatgttttggatgacccagcactctcttagcactttgacaaccctttaagtgattgttttgtttgagagcaagtgaaagaatgcattccctgttagatccccaggtgttctgtggttcactttgagtttatggcacaggcttctgggttttctccccagtcacatcttaccctattactgtccccaaatcacagcaaaaatgcattcaataattgctgaaagccagcgtgggatccagttggaggcaaactggctcagaatgctgcaaaccaaacagaagggcagtgctcatgacaacatagctagccagggtggcactaggtggcagcagatgttacagcttcctcttgggatttatgagctgcaggacatgcgacctctctcttgtctcttaccccttgtcctctgtcctgacaacttgaaagattgtcactttggaaagaccctgaccaatgatgagtcatctgtgatataaaaatagaatcctttgcagtaagaatgcccttgggattttttgatgcatatgtcatttttcaaaaaatttgggaggttggaggctttgtgtatatgtgtacatgtatgtgtgtgtgtgtgtgtgtgtgtgtgtgtgtgtatgtgaacatgtgcttgtatacatattaagggtagtagtgtataattccaatagagtaggatatagcaataggggcattggccccaacctcatcacagtaccagacaggatagactctatacacatatgaatttaaacatatcaatcaattaacctattgaatgtcaaccatgtttgatagtggaaaatactgaatagcatggctaagtccagatttttctcatcatgatgtttaaattgtatatattttgtaagaggtagtccaaacttcaaagggaccaaacagactaataaagagatttcataaggcaatatattctaattgccattccactggcgctaaatgctggaggctgataagctgaaagacatccccttacaatggaatgtttggctctcggggatatttccaattgagagagaaatcctccaaaaattcctgaggggactcttactatgatctgcacattggtctcatgatttttattttcagtaaatgaagcaaaaccctgtcttgaaatcacccttctaagagcagtgattggctttagccaggcaatggtggtgtgtgactgtgagcccagtccttggaaggtagagacaagacgagcagaagttcatgaccagcttcatcaacatagtgagcagaagttcatgaccagcttcatcaacatagtaagttccagaccattctaggctacatgaacctctttcaaaaatcagaatagggctggtgaggtggcttagcaggtaaagatgcttgccactaagcttgatgaactgaatttgattcccaggatataaatgtttcaaagagagaatcaactcccataagttgtcttttgacccccccacattcaagccatggcatttgtcttagtagttgtccaacatctcctggtgattctcctgggctccaggtgctcttgtctttcagattcttctttttcgtaaagaatattaaaaatcacatttaccattacctttatatgagtcaagggtaaccaatctgatctgcattaattatcagtattataactgcttacgatttgtcatttatttcttcaacctaacattaagggaatgaatattaagatgtgctttaggtctttagacatatgagcctgccatgtctgatagaaaagtgggctgtgttttctccaccctgtcctttctaccattctagatgtttccatggttaaacaagcaatctcaaatacaggtgtcatacggcatactcatcccaatgtcgtagttattacaaatatgataaagcaagtattccatttccagcctgtccttttcaatctctgtatatgaaaaggagtcttcgtggattaggaggtgacttcatgtctttccctgtttcagtaaagtaccctgaaaaaaaagtgactcaagggaaaacaggtggatttccactcacaagtccagggtacagtcaatcatgacagggaagtcatgtgaggagcttgtagcagttggtcacgtcatatccacaatcaagaagcagagggctgtgaatgcaagtgcccatcatcttcccgaatgttatagtctagatgcccaaccaaaggaatggtcccagacacagtgggcttttcctagttcagttaacctcatttgcataatacttgactccaggcccagaggtgattccagacctcatcaagttgacaattgagattagctagcagaagtctatgcaataatgaaaagctttcatgagatttcatgagttttcaagtttatatataccattattaggagctcttagaaatggatggggtagatctgatgaggaatatgaggtgctggggggtcttgggtgtctcctaaagtagactcaattgctgctaattgttcccatgcagaaaaatagactcatgtgatcagatcttgtgatgcttcaaagggaagggagaaaactggccttacaaattgaatctccaatttaaaaatactggccatacaactctcccagtgcccagcaagccaagcaaaacacgtctgcaggccagatcttgttttcagcctctactctaaactctctctttctgttcttgaattagctcagctccaggggtgccaggaaactttcttaactcttgcttcttcatcccccaaaaggtcctttctccctttaagatggagaaactttggcctctatgtgtctggggattatttctcataaagcacattttcaaacagtgcttaattaaatccccaattttccctaagcaagtactgtatgccatagtaataaatcagctaaacttactgtaaagccccaaagctacatatcataacccctacgtcatctctgaaaataacgtctttagaaccccataaacatactcctctgtttgtttaaggactgcaagggctttttaaacatggttgctaagtcacaagggagtattttccaggacataaatggaaatgagcataacccccttcaattgtcaaattctttatgagaagcccaaatctgtctattctgctagtggattagcttgaccagaacagacttaatgatattaagtgtgtaagtgtcaatgatcgctggagacttttctgccttatttttgctaaatgcacacattatacaaaggttggcttcatttctaacaaagtacatagaaagtacagattggtgtacataaatcctgaccacagttttcatcagcctaaaaataatgattttctgagtattgcacttaatgtttcctggtaattcttaagctgttgtcccttcagaaacaatggaagtgtgtctgggaaatttctccccagacacggtgcccagtgcaggcttttcgcttcaatcactgaacctttggattttgcatggaaaattggtagttcaggttagtgtagcaacaatctttgaatatggaagctgggactcagatattttcagaactagaaaaaaaaagatgataatcttatgccatttctgatttccatacagccatcccatcaggctggtttctgcatggaaaatacccaagcttcctttcacctgttgtcacacacaggaacaacttgtaggaagggtcatttactattggaattcaacttacccttcctgataacactctgtcctgtgtcctgagtccacaccatgatgggacataagtggatgctttctatagccaccctcacccaaagccagaagatgcagagattttgagatacacctgatcttgacatcccgaggaactgcagagacaggatgcagaaaaaggtgaaaagatgcaattaggagtctccacctgtgcttttcctgtagcagaagggagaagtgagccaggagtgcattaagggccatgccctctctataatagcacgggcaagaataatcaagcaagttctgtaaagagctacatcaataattgagacacgtgccaggcagcagcatggcttgctggggccttcaaatacaatctgttatcaggcatggataacactggggaagtaggaaaggaggctgtgcatctgtgtgtatgcacgtacacaggcttggaggagtcacaagagagttgcagccagcactgcagcaagtggaggcatagaaggcaatgtgtatagcttctcatgtagaatgctcatgacagtttgcaggtcaaacacacccttctttgggaattggatgctacaggaatgtttattggccaaggactctagcattcatccatggatcccatgccgagggcttcctctctcatagcctatttctattgctagtttactgcagtttcttccaccataagggtcctggaggtcccagagtctttgaacttaaaggttgaacaaagatctattggcagcccctgtcctttctgcctgcagactaagtccaggtgtcattctcttgtagcctaatgcattggagtctgggcccataaaaccaagtaagggaatgtcttgggttttccagctttccctactgccttcatcagcacagacaagaagagccatagggtacatattgctgggctagtttaagatctctttgctttctgcttctctcctggttgtaagcttctacattattagaagacaagatcctcctttggctgtgatttgtgggcaaccagcagctggtcatatcacctgagatcctcgtgctatgccaagacccaggcagcactggatgcaaacagatacaaacagctgccatttctccatgtagctgtatctactaaccaccctgatagagaaagaggcaggtttggggagtcactggggatgcctgttggttcatccacaaggcttcagaccaatttgacaggaagcagaagagcagctggggctgagaggcccccttcttccacgaattccccgcctcttccagattccttcctgtcctcacctgtctccaagccagccagctgtgacagtttaattggtgtggggaaggagaggcagtaggaagcaggcaggggtgaccagtgttctggaagaagaagactcctctgggaggagtgcatggaaccgtgacagacaggcctgagagagctatatactggcaggtcagggagcctggctcctctgaagtaggaatggtttttcagactcttcctctttggactggtagacacagtgtcttgcattccaatttgtttctcagtgcccctctgcactgaggcgccaagagctaggctggaagatccctgcagaagtgaagattagagcaaaagatgcctagtaggttagcagcaagactgagccctttcctggctgaattctgttctgctttatgttgtgcatccctgaacagacagattaaccctttcaagatgtaggattttccctttgtaaaatggggtgactgtagtgacaagggatagaaataatggtgtatgcgaacgctctcagcacaggactaagaacaagggttgctcaggacattagctgtgtgttgttgttgttgtttttcttaattatttttttccttggtttcattagggaaagacatgaagagacaagaactatatacactagaaagtggtcacagtgatcaattatggggtagtggatagtactgagcttctgaaatggcaaatctcaactcatacgtggttcacaactggaacagatctcagaagagacagctgtttcacaaaatgagactgagccaggaaagacccaggcccagccaagagtgtgggatggtttcatgtacctttgtttcagttatggagttagttagattcatagatcccgttttctgatttgtgatggaaaacatttccgaccttgggattggctaacaagtagcctgagaaacgttggtttggagtctaaaagagagtatgccttctcagctccaggaatttagggaacctttgaggaagaaggcaggcaggctagcactgggtccaaagctattgggtaggattatctaatacagaaccagggaggggtaaggctagtatccttagactcttctccgctttttactttaactgtaagttagggcaagggggcatgccccaaactactttcagcattaataattcactacaagggaccccagaattcacaaaaataactgtattcatggtgacagtttattacaggggaatacctaagatcagtttggccaagggaaagaggtgcacagggcagagcctaggaaggttctgcaccaggagcatggcaccttcgttattcacatgtgatcacatgccatccatacatgcagtctgggagcccagctcagcctgagagctcagctctactgggcttgactgtataaatctgggtgtttatatccatggctacctgacctcagtttccacttgctttcccaagatgcactgttacacattccagtgtgatcagccctcatcctgaatcagctcatgaccatctggttgccccaagaccgcaggtgaaggcactttgtagtcagttatggcactccaagggcttagaaaatgcctcccagaagtagacagcaaaggttggagcttcctttgaggaaaagctatgcctatctatgtaagtaagtcatgtagcaagtcctgtatagacttttcctgggaagtctgcaattggcctcttctaccacttatgcaaatagcagaaaaagaggggaacccagtctcctgaacttcagtgcccacaaggttttgttcatgtgagcaccatcacggctggaaacatacatggcttaatccagccctttaaaccttatatacctatagacaggattacccgcaaagggagcctggagcaggagatggggagaggccagcctgaacgtatgctctggaggcaggaagtatcctggtcacagggattccttgctaaacaacccatttgctgctactcagaagggatgaggacatttcctgtgccttgtttctctgcagacctgatggatggttctctagtagccctcaacggcgttaaaggataatacctgtctctctacttcaatttaacttctgtactgtaagactggataaggtcaaagccagataactcttgagctagggaataaaaaagcagattaagcctgtcatcgggccttgctgtctctctgtaacctgacctctaaccagggataattggaacccaccctaatgaatgcttaatgtctcacgtggatgaagctatgtcctaatatttagagatgcaagctgatcccaggaaaggagtgaacaggctgtggttaatgtctattagtattcattgtgcttgcgaagcttttctatgcagataggtagatcatcactttgcaattcattagcagtgtgatcttgcgttggtgtcaactcctctgacattcggttgcctcagccatcaatatggataataactcattactgcccgcagggtacttactactgagcatgtggagcactaggtagttacttgtgggtatggggcacactggtgtttattaaactggatgacaatagtgacacaaacatgagtcctctcatgtggagtgacctgtcagcacctggttctactgtgcttcctctcaggtggttttctgccatggtccataaaccagacagtggaaagaacattttgttggaaaggtctgctgaactctgcattccaggacacattttttaacttcacgggatcttagctttcttggttgcgcaataagcaagtttttcttccctttctctaacattcctatttcatctctcccccttgagatgtgtcttattatagtgaaatgtgggttctcaggcaggatgactggccacagaccatcactttgtaattcattagctgagtaatcttgcgttggcgtcaacttctctgaccctttgttttctcaaccatcagtatggacaataatttattactgcatgcaatgtacttactgctgggcacctggtgtcataggttcttactcatgggcatggagaatactaggtacttattactgggcacagggcacactggtgtttattaaactagatgaaaatgatgacaccaacatgaaatcattttcacaatgacttacacatcagtagtttggtatcattaatctttattttcattaagccggtggtttagctcttgtttagaaatgactcacaacttagtagctcaatgtttattgaatagctattatgtgccaggcactatttgaagctctcagcccttatgtgctagtatcagaggggaggcaatcgacaaataaataaatgtcatgatttcatcgatggtaaatatgaagaagataaaactgataatgaggaaagctagatttcttcagtgtttttgtgtatgttcaggattcctttagaggtctaatgaaatctatggttcccttgtcagagcatttttaacttacaaatatgtatcatacaaacattggattacaaggaaaataattatctaactatgcagttattagaatctaagaaacaaacttatgcaccgtgcttgtttttgatgaggatattttttaccaatagctatcaacacttataacacaccagtgcatctcatcagtagcattaatgtgtttgaagagttatgtcacattagttgtcttatccataaaagatatgtgggattctattgtcatcaaagtcatttagagtttccattggttgtctctgctctgtaaagggggatactacagatttgggtcgaaggataatgaaaaaaaaggtgcggtttttctcattcaagtttgaggactctctcaatgaaccccacaaactgctgctctgtggccaaggtcaggaacccagagactgtagggctccttgtgctctggttggaattctgacttcagacagatgaacgaaacaattttcagcttctaaacatcattctagatggaagtgttaatggaatcaacttgggaatcaagacatgaacccgtattgctatagttggataccttttccaaacacgtaacaagatcctctggtggggtaaaggacagcctgtggatgcacagtgctgggataacttggctatctatgcgtaaataaactcagacccttactttataccataacaaagtgaactcaaagcagactggagatttcccttccagaacaaaacacaggtttgagcctttgttacattgggtttgacaatgaatctttgaacataataccataagcagaagcaacaccaacataatagatatatcagtaagagtgaaagcttttgtgtatcaagggatcctatgaagaaaaagctgcagcccccagaactagagaaaatgtttgcagaacatgtatttaatgatgaatgtactgggctgcataaagagcttttctttctcagcaatgaaaaactaacctgattttaaagtggacagagctaatgaatagctctttctccaaaggagatgcaaacataaccaacaagcatatgaaggaaaatcaatcagccacattcagcttttactcataaacgaaatgcaaatcaaaaatacaagataccatttcacatttactagggcacctacaataaaacagatcagaaggaacacccgcaaggattcggacagattgccatccatgtgtgttgctattatgatgacataaaggctctggaacattcctcaaaaataatttttccatccaagtctttacctgggaacactgaaggcatatgtctgcactaaacttgtagcaagtgtttgtaatttctcataataactatgtggtgggaagtatcaccaacacccatgaatgggtgactggattaagagaatgtgagacaaaagtgagacagagagagagagagagagagagagagagagagagagagagagagaatgtgagatatccaagcaatgatatatgacactactataaaaagtaataaagttttcacatattccccaacacgaatgaacctagaaagcattatactgatgtgacagagtcgggcaaggtcactcatatgagactccattgatactgactctcaaggacaggggatttcatggaaacaggaatagattagttctggctgacggcttcagggatggtgttagcaggcatagcaggggttggtagtgaaatggtacttgagtttctttctgagacgaggaaaggattctacaatatggggtgtttatacaactctgtgtgtgctgaaacaatagcgccatatacgtcagcacatggattgtatggagcatgggtaatattgggttgatataagatagaattctggctgggggaaatgtaatggtaagaaaaatactcagaaggctgtctcattagtctttgctgggagattgatgcttccattggaagcattatggacaggagagcctttcacttgaaaattgggaagaaataagagagactcctaggttgtggagtttactagctggcagctttctctccaaaggcctgagtcttggttccactctgtagaagtattgggagtgctagatttaaaacccaaaatgtctgagtaccaggttaaagagttggtagccagcctgagggactactgggaggtggctagtcttctaggagttggatcttagggcctttgaagaatctatgaacaccctggtacctcttctctctgtgtgcttccctgcagtcgtgacgtgaatacacccactcccccaggcttctctgctacaatgtactagctgctactcactggaagggacagaatcaagagacaaagatgacatttctggaactatcaccagaataaacatttctttaaattttgtatttatgcttatttagtcgttgttgtgtatgtatgtatgcatggacacatttgtatgctacagcacacatgtggtagtatgtcagaggacaatatgtaagagtcacttttcctcttctactgtaggttccagggattgaacccagatcttcagtcatcttcattgtgttagctctatatttctccttattaagttgtctatctcagatattttgttacagcaatgaaaagttaacacagagaactagaggccaacttaaacaccagcagccccggggagagctattttggaagctgttgggataactgattccattgtatcatctaatagataatagataaaaacatacatatagatacacaataatgcacattttcacacacatgttcatgtatacacaacaatgatataaaagacagaaaccatagtcaaggaaaaagcatggtcctgcttcaccccaggctgtgactgttcatgcccatgttctgtttgttcagtggcagtagatctcagattaactaggaaagactcacttcaactctgctcctaaagtgtgcccatcaagtataggttccccagccacatatataaatggtaaagagcaggagcgtgcctttgcataggcactgaagaacttagatagtgtcagagaactaatagagaaaatagtcacatctcctccatccctgggtcccaagggaaagcctgccttggtgacttgtccatccaagtgtgttgaactgagttgcttggtgtagtggatgtaatgaaggaactctagacatttaaaaagtcatctgattgcacagtgaggtcacctgcttcatcctgagaagcagccaatctattacactccccaaaggcagaaaatacactgctggtagcatcaggggtgttcctagatcagaatccttctgcaggaatggatgggaggaaggacaggtttcccttgcattaagagcctggagccaaagaggctgggtggttcccagcaatgctgggtgatttatagccctcaatgtcatcctgattttcaaccactgctcccctgggagcctgtgtgccagtcccttagggggaaagagacaatggactgatttttaatggcaacagggccaacaaatctggataactcctgactgaacacaaaggtgcacgtgtttcttctcatctgaaaaaacatgcagtgtggtgcacacactgcaaagtgggacctaccaggctttgccactctgaagaaattgtgcacaccagtaagagagaaagagcgggcttctgccagttttcacatcgctctccttagcttggacttcaccatagaacctattctttgggatgggttcccatatcaaatcatggttaattagaaaatgaaaatttaatatgattattctatggtgcagttgagggtggtgaaagagacagtactggctgaggaatcccaaagctaaaccgctctaaccatttacagttgtatgctattcctacgtgggtttactttctatcttgtccacggttgtcattgctgctcaagttcctttcaaaacacacccttcttatttactgtaaaacacaaagctcttggccacaagcacctttctttggaggagtcaatggtgtctatattaccagcgatctacactttctacccagtatgacttctagccacccactatatctcagggatactttctttctagcatgttctgtcctaaaagtctattgtaaatatctcttcttttgagcctggaagataaagctgactcgtcaaaagtaagattgaactcccgctgtaaacgttagtctctacatgtagtgttggctgtaatcatattatttcttttaaagttagaattccgcatctctgaaaatgacagcaaaatgaaatcaaccagagggcagtttttgtgtgaatatatctcatgtactacacttggtggtttagaattgttccaagacttgtgtagtaatgttataagcatgtgtgactctgaagtgggctaagaactaaacacctatgaagaagacttttaatttggtcctaagagaatacatgctttacatgataacttacatctgactgttccttccaagtcactgcctgatgccaaaagtttaaaaccacagtaccatggaacccacaagcatcttctagaacttaccgaactcacaagccagaacctgggttcaggcagacattcaataattaatgaggtatattactttttctatttgtaactaattctctcctccacaaaaggcaagaatttagtgggggaaatctctctgcttctccttgtctccatggtcctcagattgcccagtattctgtttccagagtgttgacgtcagtggaaacagcacacacatagtaattatctaatatgctataaacaacattctatggtctggcagagaaaataatgccccaggcaaaggggaagttgaattatgaaaaagcaataagccttttcataattacacactaagaaagagaggtctggtttttaagctaaacagaaagtgccaagggagcctattttgaagtgaggaagatgccccacccccacccccacagtgacatgcaccatcccacctctgagcaaaatggagaacacagtcagtctctcattgtacatcctgaagcacgggatggtcgccagagcccatcaccttttccgtggaatctcttgggtgcagctatgactgatacttctatgctagacacgtcccgtcttgagctgggcaagcaaaagatgaatgagtccccatggccctgctgtagattacttagtgccagttgtcagttcttctatcccagggaagggtttgcaatgagactgttttcgacagactgtccatgataaatgattttcccagtaagaaattgcttttctgctaaacctcacccaatcatgctgacaaatgtctggctatagagaaccctgctactgctgtctcagaaatggggtgggggtgggggtaggtagtggctgggatctgaagccaggatgggccaaataggaggtcttgtgggtgaagacaaaaagaggcaggggatttgggttctgacgtatgtgtttgatcagctcctatcagctattgctgagaaacgaccagcagagttcagaatgttcaagatctcagagaaggaggcggcctcaagggctgcgtgtgcctctcagttctggttggtggtatttccatgtaaaactgtgtaggaacgcagcaactgatgtcagctataaatagaacagaaatgcgtacacatagcaagggcaagaacctccaggcaatgttctcaacctgtcattagtctgtgaccctttctgaaccatcataaaaatagcatgccctcctttaatattatttggcatttcaaaagagattaaaataccaaatctaaaaatcttaagtgactgttagaattttgtcttttccagctgaacagagtctctctttctcttccacacactaggaggagaggagtctgttgcagtggcagttagatgttacatgttgtgtgtcacttggcaacagaggccctgaggccctggcaggttaatacctgtagacttagaaacctgggttcagggttggtgccattgtagagttgttatgctagggccttggtcctgcgagaggggatcatagcactatcagaagggacatgggcagtgccagggtcagtgttgcagtgctcctttgcatccagcctttatttcaatggcctctagtgcctgctagctcttggtccctgccatttcctgagaccctgggaaggacaaattccccgagttgctcatcccatggcacaggctggtctttgagctgtgacttgaaggctaggttcagataggcaggatgactttgctgccatactaaaacgtttgctggggagaaagaggctcctggagaagggggccttactagtttaccctagaggattactggggacactagaattagcttttcctgtggttttcataaaagggcctcctgggaggttcctgctttcttccataacacgggaaatccccttgagctggtagaaacaggtgggccatgctccatttctcattttttttttctggaaaaggccccatctttcctttaacacaacatgcatcccccctgtccttcctcacattgctggcttcctcctgctgcagggtaccacaggttggccccctcctctgtctctagacaccatgagaaggagcttctgaatgcttccccagccttgcagcgctctgcataaatagctcagtacccgtttgctgtgggtttgtttttggcttcttcctccatccattcatggcacatttactaagcctgagcacatatcagactatcccgggaccagagaatagacagacagacagacagacagacagacagacagatttttctgccatctcctctggagcttgacaagaggtagcattggtacactagcaatgaaaatgtgtttactgtcccactacagcccagtatgtcctaatccacatcttgtttccttactaattcataaagcctcttcgtaagcctgcgaggtgcttctgtaagaatcagactgttctaggtgagaaagtctggtaaaggaagataaaaccagaaccatccaaatgatgggtgacaccaccagagtctgcatcctgggaactctgccttcagagactctgtgtcctttgtgtgggactcctgtggcaactgaagggagatggtcctgagtcatcattggatggtgtcctggtttcctcgttgtcggggagcagcctggctgtcctgatagtcggctctatctctctgcagtaaggtttctccacacttgatgtcttgtcccttaaagacctaaataactatatgagcttgcctgtgctctctatttggatccagggacttggacgctgaactgcaaagaagaggcgatgtttaaacccatgggtccatctgcatcctccaaatggtactttgaaagtcagtcatgtaaagtagaaagactttaagggaccatccagaagaaatatgacccctctatccaaccaggagttaggagtaggactgggctacttcttgctggtcacgaaaggaactggaataattgacatctgaatttgaatctgaaactaatcacagcttcaggactcaggtgtgtctgggtccacaaaactaacatgcacacatactgcaaataaaaggagtagggtgattaagtttggctggtctctgaaaggcaatcatgtccttaagtagtcatgaacatagcaccaagcacatagcagacatgtgatgggcaaaaagctcacagccttctgggaccactaagcttatgctggccatctgctttaggaattctctctactagatattctggaatggtggcatagtatagtaattcataggcccttcccaccgtgacttaatggatctctaggaagtgaacccgtaccaccaggactcatgctcctcagtctactttgtatatgatctctgcttgatgtcagtgtattccttttgcactgtgctaattaaaaagctgatcttggtttgctgattgacacctcaagtgaggaagggaggggatcttgtggccagtcagtgtgagagggagggcaaaggatccatactggaggctatgaactcatgagtagtatttgccttggcagaggctccttagtcccgagatgcctgactcctgagtttccagtcctaatgtctgtgtggctaataaaggaagtatctgtagagttactgttctgggagtctcacttttggctgagtctagacagatcttcactttcctgcacttgtactgtggtgaaatagacagctagctactctagctgaggagtgagacttatgataaggactttaccactgaaaatctagatgttcaagagtcatctgggtagcatctttgtgagcaaaccatagtggttagtgtcatctgaaaaggcagcacattttggtttacatgatgagattaaaagaaaaacccatacccactatatatagtttccaaaatggtaattctgtgcaaacaaagagaaaccctagcattgtttcaatatagttaagtattgagctagcacacatcatactcgattacaagatacagtcagttatagagaggctggcgcgcatcctaagtgccctacctcactcagctcctcagggtagatgctcatttttcctaggggaaggagcaactttacccctggcagtggaaatgtcaaggacaaggcactctggtctcaatgttctcctggctccatctttctgaatctgagtcctggtcaataaagtaagagtcagtttatcagggttgtcctagaatcattgcaactgtgctggtaggcccagccactagaggatctagaactttcccattgacattaagtagccagctaccccaggtgaacacaagctggctgctgacacaggatcaactgggccttacagcaggtccctggaacctagttatgaaggctgtcctgggacatctttgtgcgtcgtagggcaatgtcagagtttatttgattgaaatggccagacctcgtttgtaacatgttgcaaggagaggcagagtaagggaagaagtaggggctggaggctgattttgattaagcttgccatttcactataaaatctataaatgggatttaatacactgtgatgctcaaagatgactctttattttcttattcttatggatttctcagaggattaagcagttgtcgttgtagcacagagacctgaatctttcacaaagcctctggtgcatttcccagacacaacagcttctttttggtggctgaacctagagctgcctcttcctgtctcccagagagaagttttcactccctaaacactgtgatttgctttcttgtgttttctataattgccccacaatcccgtggtccatggaggccatgttcatcaccaatcagaactatagctcagagactttatgacatttgtcttgtcacacagcttggaagtgtcagaactgaaattcgaactctgacattttgtggctacaaaccccaggttctcccaggctgtactataaatattcttggatacagagttatggtggcataggttaatcctttgaagcttaatgctcttttctcttctttcttttccttcttttctttcttctcatttgcttgttttagtttttgagataagagattctctgcgtccccttgactgtcctggaactcactctgtagaccaggctggccttgaactcagagatttactgcttctgttttcctgagtgttaggattaaatgtgggtgctgacaccacccagccaatgctctttctttttaagatgtctgtattgggagatgttgaactctgataattgaatgaaaatcttaaattctggatgtgtgtatagaagggaagcaaccgcaccccacagttttgcatgctttccatggtctcttttttatttgtttgtttgtttattgagtgtttgggagactcttttaagaaatcccttccgggatcttaaggagtaagaactaagcagtggggaaggaagaggaggagggcaaggttgggggaagaaggacagaaggcaaaggcaggctgggaagcacatagcaaggagtagacactgctcacactgtgaacagttaccatagcaaggagtagacactgctcacactgtgaacagttaccatagcaaggagtagacactgctcacactgtgaacagttaccatagcaaaggagtaagcactgttcacactgtgaacagttaccatagcaaaggagtaagcactgctcacactgtgaacagttaccatagcaaaggagtaagcactgttcacactgtgaacagttaccatagcaaaggagtaagcactgttcacactgtgaacagttaccatagcaaggagtagatactgctcacactgtgaacagttaccatagcaaaggagtaagcactgttcacactgtgaacagttaccatagcaaaggagtaagcactgctcacactgtgaacagttaccacggtttgagcctcctggctcaaggactttcttttcaggtcacttgctagagtagtggtttatatatcgtttccttatgaacccagtgacttatcctaatttataagccccctgcctatccaactctctcttaagttcagtgcccgtgggaggcagggcgtaggtaatttcattgagtttcaccaggcctttgtgggtaccacccacttgccagtggcctgtcagtgactcttccacccctagttctctaggttgtatggaaaggctcctgagtatgggagctgtttatgcacagagggagactctggaaggtgtggctagtatataaaaggactatatttaagagcatggatgattttatgtttgcaaactttctatcccaccatggaaggaaggggcagacatgatcaacctcattcattgtttgagtatttttttttctcagtgctatgacaaatgcccagaaggagcaacttaaaggaagaaggatttatttggctcacagctgcaggagatacagcccattgtgacagagaaggcttggtagtaggaatgcaaggtaacagagcatactgagtccatagccagggagcagaggaacagggaagaaagcaggctgttctgcatgcctcctgctttctttcattttgctcagtcttgtgacctctccgttcacaggatggtgctgcccacgcccagaatgactcttgcttactaagctggacatctttggaaatgccttatggaaatgtggagaagtgcaacttctaggtcattccaaatccaatcaaattgacagtgcgagttaaccactttcctccttcattttgtgtgaggagaacgtaccctgtgacagacccctcttacagcggcccctggagatgcacatgatgacctgcatccctttcaagtttcctgtctaatgccctgatatcttggaaacgtgttaaaaagaaaacactttcccaggcctagttctaacaaaggcagcccttccatctcagatcctgctggccaatttctagagacaccgcagaagagacctgaacccatagagagctagaggggcagataactctgacagccagtggactcctgggtctggccttaattaaggcagagtttggaacaactcagcctagtatcaaagcacagctttagtgacccaaaggataggttatttacctctaagatcttcaccccaaatcccaaaacctctgccagccatggccacagacttctaattcttagcttcacattcttttcacttctagaaagcatcccccttggttccccttttggttaaggaatatatttgaagttttaaggagatgcctgttatgtatagggtagataggtaaaattggcaactgtttataaaacactttggtgccgtgatatgcctacacaccaagagcaccagatggatatggagtgagtctgtataggtgggtgtcaacctaaaagagaaaaagaactaagtttaaaacagaggttgggaactggcacttctcagtataaatgagttgggttgctttttttttctttctatttcggttcaaaagtcagcatagcaagattccataacaatattcttgtttggtttataatgtgagttagtttgtaagtgaatctcatctgtatattatatccatggaaacatctccgacacacatgcctgcaatatctgccctgttgtgttgtgtttagatgtttctcttccccccgccccccatttattctgggtcatcatgaagcccttccatatttttattcttatagctgatttagagaacagaactcacttggggaattcaaaggtagccaaaaaatattcttacaaaagttaattaattaaattaaaagcagtcaaaagaattagtcacagtagtacgcaccctgagtgctagctacaggaagggctgaggcaagacgagcttgtgaacccaagaactttaagctagcctgggaagtctaaaggcacactgtctctttgaataagtgaataagtaaagaaaataaatctcttatgctgagtgtctgcttgcaggtcagcctaccaacgttttgtctcttggtggtatataaaataatacttccttttttgcttagtgctgacttcaattagtaaggctgagtcattttgcatttttaaaagctgagcagatggttatatatcacttgattgtgaatctctgggcatcacagaacaacaacaataacaacaaaatccacttggcctgaagccatttcacatgacattggtaacaaagggacaaagggatttgtttgtttttttaactaggccttggggcattaccaccgaacctcctagaaggaaacttcttggtttttacagctgtgaaacttattaaggatgccttataggattgtagagtgtttgaaaattacctgattggatgtctagttctgtgcacaatcttaatctcttccctaatctccttccttttctccatttacctgaccgggccctgagattagttggttagttggttctttcattggttgatgtatttgacagttctagacacttatatcaccatacatttttatacactccattctcctccctctcattccccttcctttcctgctggaaccacttcttatcagcaagtctccctcctacttccctgccttctttttgggtgtggcccacttttcctgttatggagacagtacctgacacaagcaacccaggactttagttgagctcacagtgttagcacagagcaagcatgttggctgatgtggccaggatgtttggtgctggggtataaagcagctgatcgcactgggagacaaacaggaagcaagaaggaagtgggatgaggtacccttcagtgtcttcacctagggacccaatgtggattaccatgtctctcactgaagagctccacaatctcccaagacaagtctgtaaggaacattttacactgaactgttaacagtgtctgttaatagtgtctgatgataataatgagagtttttaccaatatttaaaagcagagtgaagcaggaggaacctgggtgggaacctgaggaggaacataactgaaaagagcgagatagccagcaggagactgctttgtggaggaggaagtggccacctgccaaaggctgggaagacaggcactcagaattccctgtggagtttgccacatggatatggtcagcatccctgacaagtgaagagttagtgggtgacaaggtgagcgctccaggcaggctgaggcaaggagcctgtgacagtcttctggaaggaagccactgtgagtgttggctccagagctcagtagcaactctgatagtgaaggctgaacacccatttagggaggcccgacctctcatcagaagaaggaaggatagaaggtagtgcctgaaaaatatgagtgcagggaacagagtgaagcttggtcccggtggctttcactggaattatgagctgagcatcagctgagatggtgatacagggagggacctggaagaggagagaagcactgtgctttcaatgtgatttgtcccctcagagttcctgtgttggtagtttgatctttagtatgttgatgctgagaaacggtgagatgtttcagagatgtggccaagtcagaggtcacaagatggaacacttcccagttctctggctttccctcctgatccctctgtgtagcccattcttcaactattgggatcccaccctccttaatgcccttaccagagtaagggagaagccagagtgatgcctggaacctctcaaacaataagttaaagagttgatcccagactctggtatttcattatagtaaaaataaataaattaataaataagtgcaaagaaagaagaaaaatgaagactagtagccctggaaatttgaaaagcaaatcaatttgagaaaaaacaatagcagtctgaccattcttactgaggaacacactgaaaatgaaccctgtcatttggcccatagccctacctggaggtatacagctctggggtattcatgcagcacaggggaaaggtcagtggactgcagaaacgtacaaggaggctcagaatggggagtaaggctcagcactgagggctgccagccaggggttctctgagctattgcaagtggacaacatgagcaaaagaatgcagcagtgctaaagaatgagcagtgaggaatgtcacagttgctgctgctcacctgaaccagactggggagcaggaagggaaagatagcctgcagtgaagttagggctcactgccaattacaagactaaaggctgagctagcacctttctggtggtctgtctccatttgcctgtgaagatgagtgtttgtttgccaaagactgagcccagtgcttcatcctcaaccatcattcctatgcccactaataattgtgtgtgtgtgtgtgtgtgtgtgtgtgtgtgtgtgtgtgtgtgtgtgtgtctgtgctcgcgtgtgcgcgcgcttgctctctctcgggcgcatgcatgggcgctgtcaggaaatattttgctacctgttgttttgttttgtgcctcaatgaatttatttgaattgagaacagtcatgaactgacaattttgggaatccacaggctgctctgtgcttcagggacagtgttttggggtttggtagtttgggtcttggagtgtctggccacaaatacttcttcagagttgatgttctagggtgtcattctccagggttagattagcagatagtgacgaattggaagtccaagttgaggtcttgacagctgctgcccagggccaagaactctgctgatttccaagaggccaggagtgtcctttctttgcaggccaccctgtgaatgccatctcattgtcccacatcataattgtatcattacacgtcataacaatgggactgcaacagttattactgcacattctaattatgtgattactcagtctttcaccaattatataattagatttaattataccaattgcacaaacaaactatagtcaactacacattacttaaaataaaatccagaactgcgtgtatggcagcagttgccctgcaaacaagaatagaaagcaagagaagaaaggtttttttttttttttttaaaccaatttttaagtggaaggaattatatgatctggtagatctttaaggataatggcaggaaattaacttatcatgaagtattttaaaaaaacacaatttctttcaagaaaatatggaggatgccaaccaaatgaaggatttattccactacccaaatagcttactgagaatggtgagaagaaaagagcaggaatgaggagagagaggcagagaagttcctatgtgggaggtggagggggatggggcatgggggatagggactgaacaagtttgacatttagtgatttaaaaaaatcatactgtgtaatttgaggcagagcacattatgatgccaatgcagctcagattgatagattgagccttagccctccttacctaactatttctggtatttctgacttcctttcaccctcagttcattcccccctggataggaagtccaggtatagctacttagaatcactacctagcactccaaatcaatacaagcagggcaggaaggtttgccctttgcaggttaagacttcagggtcagcaccctctggggttgtctttgagtatcatttgtgagacaaaatttgaataggcaggtccaataatccatgtcatactcatgattgcttgccctttgtataatctttggctttgaagaattcgaacttggtgccataacatataggtgacctctgttttccctactgtgtggaaacaggcatcctagaaacacggtattttctggagaataggtttttcttttttttttttccattttttattaggtatttagcccatttacatttccaatgctataccaaaagtcccccatatgccacccacccccactcccctgcccaccnnnnnnnnnnnnnnnnnnnncacccacccccactcccctgcccacccactccccctttttggccctggtgttcccctgtactggggcatataaagtttgcaagtccaatgggcctctctttccagtgatggccgactaggccatcttttgatatatatgcagctagagtcaagagctccggggtactggttagttcataatgttgttccacctatagggttgcagatccctttagctcctcggctactttctctagctcctccattgggagccctatgatccatccattagctgactgtgagcatccacttctgtgtttgctaggccccggcatagtctcacaagagacagctatatctgggtcctttcgataaaatcttgctagtgtatgcaatggtgtcagcgtttggatgctgattatggggtggatccctggatatggcaggtttttctttgattaattctaggaacctatataagccatggcactgtctaggctggggatgtagcttagttgatgagtgcttgcctcgtgtgcaagagggcctgagtccaatctcaagcactataataaaaaataaggtgacacctatacaaaataaattttgatttggcctgcaaaagaatgaaaatatggtcatttggagcaacatggtacatactgtgttaagtgaaataagccatggaagaagagctcagtattggctgtttgtgctcatatgtggaagctaaaaagttgatttcaatgcctaataatgatttctaggctgggaggtgtgagggaaataaaaggaggttagatatcagaacagacagataggaggaacaactgtggtgatgtccagtagtgaagttcaaaggctcccaacacaaagaaatgactaagaagagggaatgctaattacactgatttgacctgtgcacacccgacactgtacactacaaatatgcacttaatacatgttaatgagaatgaaagcaaatagagaagactgactggtgccccatggcctctacctggtacagagcccttgctgttggctgcttctgcaccctaatggagaagaaagagtcttcgttgttaggtggctggtaagagcacatctggaatagtgggcataccacaattatacctcactaaagacatgtaattggtggatgctgcttaaggacatacttcagggaaattctctgttgagcttggctgagtacgagagtggctcagcttctgccttgggatccttacaaaggttgacaggatatggattgctgcaaatgtacatataatatctgcggtgtgtgcttaacactgctatagaaataagtcttggtgctacgctgggtcacaatgggggtgcagcatacttagtttcatacatgaatgaaaaatttaccagctgtggaactgccaacacacatgtgaggggggaaatgtgcttttaagtctcagatagaggtgtgcgtgtctactttcttctcctgcagagttgttcatggaagttaagtgaattttcccctggatatttccatctgctcttcagtttctgcagtgctctgggatgttgttacttggctttgcagtcccataaaggcttccacttttgcacatagatttatttgtccagtgggaggttaatgcacagctctggaaggtgttgcccagcacaagaaagtacagcgatcatggaaattccagcaagcaaaccctggaaaactggaacttagagagggaattggactggcatggcacagctcacatttccttcctcatcttcaaaaactcagcaccagagccaatcaggagaaactgattcttatcagcgggattgcaacttgctggtgtttctcagtccactttgctaggaactgggaatgtacagagcagaagatggtgtaaagcaaccccagccatgttctaaaagccagcaaaactacaccaactgtttttaattctcagttcagagctggccatctctggttagcttttctcaacagaactgtcaatggaaagattagaatctatgtgtctgtcttggacctctcccatttcagcatttatggtatgcctgcaagctcaggttccataggatcaacgcaagagtgtacaaaatgccctctgtaggaaatgtagtcgatcctgaataagcatcagtggagagggagaaagcaactaccacaaggcaaacactaactaggtagtcagtggtcactgtggccattcatatagcagatgtgtatcagataattgctagtcaggaaacagacctagctgacagctgctggacattctggtcacagaagttgctctctgtaattctacaagctgtatcactagctattgggaacttactctatgtaaattgccaatctgtccttactaccccattcagtagcaccactgtgatttccttcatttgatgaagaaaaagaacctaagttgttgagatcatgttgtagctctcttttgctgctttgtaggttctttttttcttccacccctttcccacccttttaacccctaacactagataaagagaaaaaaggatagaaaggaaaggaagcaaagctatcattatactacttcctgctgtttggggtatcgagttccttggggcatttgatctttgccattaggatatctaatttcttctttcttctttgtacatgactacttaacaaaccacaaccaacagcaaccagtcaacaaccaacatgtttccccactgcaacaacccataccacctctggggttctagcatttatatgccctctgaaaagtccccagaattctgaacatcataccatgtgggtagtcactgggactagagattgagcccctgatctggatgaggagttcctaatcctgggacgacacatttcgctagagtctaggatctgtgttgtcatcatgagcacacactgtaagtgtgggcaaacactgaactgaagagactcctcaattaattgtacatcatatggagatcttgggactaacatttgccagactgttaatgtgttctttgcctaaccagataagcaattgacaaggagataattttgttctactttgaaatgagattgggagtagtggttaagatataactcaaaattggatgtcagatgcctttcaaagtatgtaatagagatgattaaattatcaaatgacttgtattggtacaagagaaatgaaattcctttcatgtgggtacaaaagtcatatatagctaggaattgggattagaggtgcttcatgctggtactgaaaccagacagtgaaagtacttgtaaactaatactgccttagcttagtaaaatcagacaagggctttaacattcaatcttttccagcattccttctgctctgccctctgtctattcatttgttcatctataggacatgcatattgattagcagcgacatctaagctttactgaaagattcctgtctcgtggagcttgcttttcagtaaagaaggtcaaaagtaggggtttggagagaatgtcagggggttactgtgtttgtagctttgtggggaagggggagattgggtgtgggaaagtaggctgagcccaggtttgcacagtctgcctagacctccctcagggcaggcagaagcgttatgttcagcaattatgacaggaaattgacaagtgctttctaggtgtcctgtctcagaatttaccgtagtctaaataatttcagagaacttctcctcagggaattttaaattatctttaccaagttgaaagaattttatgtcatgttgataatttagagaactcttttcattgagttttaggacacaatgagaggaaaatttttgttttcagcttcgcacagcaatgaagtgatcctaatttgtcttagtgctaacagatcacactttaagctgaggaaaagcatcttattgaataagatcattcttaagacttaactaaaactgtgtggtttctctccttatggtgaaactttattcttttataacatctctgggcagggctgccttgaatttataccatgatgtcatgtttcatttgagcaaaagtggtgcatgaatttgtaccattgtattgctgctcatgagaagcaaatgtaattaagaacttcctgactaggatttcatttactcaacagttaagggcaacattgttagttctctactcaaagcaattacaagtagttctattgacagcacactattgcaggagctagggacaacttcaaaactttgggcattattttacaaaatgatcctgatttgcacacatggtgtttagaaaaggtgaaggcctggggaatttgaaaagttttgccacataaacaagaggatttgggttcaaatgctaaggagactaaaacaatggatatatagcatgcgcacttggattcccaaagttcttactgagagatggaaggaagggagaggaaaatcttagccagctagcttgttataagcagggaacaaaacactggaagacccggtctcaagcaaggtaggagtattgacacctgaggttgtcctctgacctagaacatgggctatagcttgtacgagtcatattcatacacatatatgcacatgaacaggcacactcaccaaagaagaaaaagtagtaaccaaaagaaactgaccatcaaaatcaatcctgacctctaaagacaaataaaatcaaaaagtcagtacttagaaacccctttcatgccaggtgttttcttcacttatgtaagattacccagagtatatcatattcaaccttatttagagtatattagagaatatttagagcatgctagtttatatccactagcttagtgtcttaccaaggagaccctgcagatccaaactcttatgtgaaatactttgtcacgcttggtttttaatgtgcgttcccattattgcttggatccttggctctttgtgttagatgtctgaaggagtggaccagtaacattgacccagattgacttcctaacttctgatgtacacatatctctagatttctaagttataattttaggatgtttagtgtcaagttttggtccagatttctgaactaaagtacaaataaacaaaaagtaattctagtctaaataaaagggagatccatttttttcatatgatttttttaataaagaggaagtggttatctttttatttaagagaaaataatttagcattgtgatggctaatgacacagactccaaacaattcaggacagaattcttctaatataagattcaaattctgccgcggcatctcagggctttggcctttcttggctgttcagaacagatggacttattggggggtgaatgaggctatcggcaaggtcatgctcccctcttgtcctcaagtgtgttctgtgttaggtaaaataacccatatttttccaggggacaaagaaggactccataaggcagtctcttggggtcatgacagcacctgggggtagcattaatatggttgatgcaaatatcacatagcttaggttttgatctctatacatgattctggggctacttggaaatcactttgcaagatgagatttcttgacactagcaactcacagattacggtctgctttctaaagtctgcttattttcttcctccatcccttaatttctcttctcttctttaaacccttatttagggtctattgtatagcccccattagagagctcaggtgcagcaggtaagggggagacagaaacaaatttcctttaagtcagtgaaggtgctaggaaagacgtgctggtgaagagaggaaagccccaggaaaggcctcagtgattctaggtgagaggaggatgcaggaagacttccaagaggtggtgaccactgagctgaccattcacagtcacaaggtttgcctttgaaatgtgccagcataggagtcaagtgggtgaggcagcaaccagtcctttgcttgtgtgtatccttgtagcttgctagatccctgggatccttctcttgttcactgcttaagacatttctttagaaagtaattgtaagttggaaaggcccctttcttcacagcagacgtttcctcgctcttttggggaaggctttgtataactaaccagcttgttcccaggtcaagctgttctggttgcttaccatttaagcagaaaaggtggaaacaccaggctttttaaaatccccagccacctgcaggtgaaattccaggtgggcagcagcagtagcacaggttctatttcaggaaggagggctggatctgctctttctggttgctcatctgttaggtgttcagttccaggagcttttaggcttcacacatttccgtgtttttttctttcatttctcacagaaagatgaaactcatggccatgttctttgcagtttttgttggtctaaggattcatcttcgtagcttcattttgtgcattggctttacttccaatagtattggccaaagcaagggcagacaaagagggtaccacccatggcaatggcagagggtgttgcaaaatgcctaaactctaaacattgccttgtctctctttctgccttgctgcttatctgcgattccatgattagctttcatagttggagcaggttttaatgcttactcctcatgggagtagaccttcatgtctccttgattcttaagtagacatcagtttttcacttcttcatggggttagcattgaatttttggcaaggaaagagataaactggaataggaaatctagggtagccttctgggggactgacagtagtggcatcgttcagcctggtactgttcagtatctgcttatctgagcagattgccatgatttcttcatcccaggagttaccttatcacatgtgttaataacttcatttattaccagttgatttttctcttgaagaaagtctcagagacttggagactctgagaatccatgtggtaagtaaatgatgcttttgtttaaattaatgtcctcttttgggacaattgatgctgtcatgcttctcagtagcttcctactcctgttttgtgtatatttctacatgctactatacatgcaacaggtgcctaacacaggctttctaaagaaacccacttgcagatttctaatagactctgctcaaatagagattgtattggctcctcaatacattacagatttttaatgtgctttttatctatatgtatgcatatgcactctgcctgtgcaatgattatggaggccagaaagagtgtgtcagattctctagaaatggttatagatgtaagttggtgggaactgaacctgtatattctgcaagagcaaacttgtagaatgataattttacatcacaatagcttaatacctacaagagggtcacaaaagctactgtacagcatttctgggtgaaccatctcacctccaataattctgttatatagccacagttcactgtcacaacttctgacacatgctgttaacttgagaggaatttgccagctgtctacgtttttgttttgcgtgtttgccataaagattgataatgatttatcccttgctgatttgtgttaccaacttcccagtcagcaaacaaaattctccttgcaggaccacataattcccttatgagaaactgaatttgaaaaagagaaacaactttgaaaggacacactaaagtttatattaaatcacattcgcagattttgacatggtacaaattcccaaatcttgtttaaaattcaacaataagaaaataattgttatcaacacaaccacttttagacccaggattatagatatctgaaattaaaaaacatctatttttactttgtttaccaagccatgcacatcaaaatgtccatgaacccttgctttttcagttaatccaataagaagctgttgtcaactgagtagtgattcctctttgatatgtgctcatctggaactcctaacaaatgtgggtgtgtggagggccttactttcacaatgagacagctggggaaggcatagcctgagctttctctgttgatggtgttgctcaggcattttagtagtctttgctggttgccatttctaccccagacataccattgtcacttggggaaggtgacagtgctctgaggttactttgcattgttctgtttggtgactgtgcatgggtttgtctgttgttggagccagcagggaggaggacacagactctgttgggtttgtctagttttattcactccagagagaaaggagatggtagcccagaaaaatcccactcttctcgaacctggagagacttcctgcatcttataggggtggcaggtgcaaagatcagatattttgaacttaagatctgtgacagcagtggttctcaaccttcctaatgctggaactctttaatacagttcctcatacgctgatgactctcaaccacaaaagcacttcattgctactttataactgtaatgttgttactattatgagttgttatgaattttctgacagtcttaggcaacccctgtgaaagtgtcatttgacctctaaaggcgtcacaactcacaggttgagaaccactgtgttacagtattctggatgatggaggtgagtggagacagaatatccaaacaaaagcatcctccagtaacattccttcccattgagtgatccctggctgagtggacacgaggcaccacagtggctgcgactatggggagtctcagtctgtttccatggtgggttcagggcatcattgtctcctctcagaagccacaggcagaggtaaatccatacagtcagcatgactgcatggtctctgcaacagggagacgacactctcctctttctgctccatgagccatgggggcagagctcccatcacagttacactttaaagttgtgctaaatggacataaacacacttggttacattttaaagagaaagcactctctgaaaaaaaaaaaaatcaccttccctcttaactcttctgaccaaagggaagtctctaagaatgaggatttcaggtgtccttctgggagctggaacatccaagcccccaaaggaccagggttgcaattgtcagttggtctctgtcctttaagtactattgtcagtgatgattctgaggacatacgtaagtcatagctcctccatatgcctaagtttgaccacatgcatcatacctaccactgtaggcatgtgtctgtctgtatagatatccctgttcaaagtatagaggcaggcctctctcgaatgcttttctactgtcatttaaacactgcttttgtagtagcctcttggtaaggtaacttctttcagaagacaaaaagccatgtgctttcctttctttgtgacagttaagaccacagaaatagacctggatggccattgtggctcagagaactactttgttggtattatgagcctgtctctaaaaaactttgacagtgcaaggctctgaagaaagccattcctcaaggtggccttagctgtcctgaagcagagaatttcaccttaggacttgcataggttagcgttaaagagatggatcagaggtcgatagtactggatgctcttgtagaggacctgggttttggttcctagaatctacatggctcacaactctctgtaactccagttctgggatctgatgccttcttctcatcttcttaggtatctggcttgtgcctggtatatgtgcatccatccatccatgcatccatccatccatgcatgcatacatacatacatacatacatacatacaaacatacatacttgcaggcaaacatttatacacataaaaaaatataaaaattacttctttcttctgggatttaatttgataaactagccattcccctacatttgagtttctgtcggcttcctgctatctctaggatgaagaccaggcacattaatgtgcacacaggtgcttcactatcttctgtctaccctcggttcttgccagttattcaagccagtaggctctgcaacagtgtgaggctctgtgccctattgtatacccaaatctctgcccacactcagttctccactcctgtgccccaacccaccttctctctcagatcagtgtctgttcattacttaaaatccatctcaactcactcagagatggtcctttcatcccaaaaacctctgcttattacttaggttggagtcttagagatcacagtaggtattgcggacatagcatcaccaaagctggccatgatcacagcatttaacatttactattttatctctctcaacatctcaaatgagttgtatttacatgtaagtgaggattttaaagtgcagagagattcatagcttgtctatagccagaaaaatgtatttagtgcaacttcgaaacaagtcactcttgaatggtgtattgttctggagtagcaactgtgtgtcattgaatgtcgtgtccttccaacaagtggagtgcccgccactaaagaatgctggagatatctgttgaatgagtaggctgctttgtccagtctggctatatttatctttatgttctggggtggaactcaggtctcagagggtgttctgctctcagtgagactgacaggtggatactacgtcctgtttgttcacagtgtgtccaagtctttatcacggctgtcatcacgatctgcgcaagctatgagcaccaggagagcatattaaaaggagtcatttaccaacactatattcctcactctccttccagctggagagagctatgggaaaggattgcattgccaggattacagtacatacctctatgagcagtattcagtatctttgagatcatggaaggcaggcaggaaaaaaaaaaagaagaagaagaagaaagaaagaaagaaagaaagaaagaaaggaaggaaggaaggaaggaaggaaggaaggaaggaaggaaggaaggaaagaaggaaagaaggaaggaaggaagggagagagagagagagagagagagagaaagaaagaaagaaagaaagaaagaaagaaagaaagaaagaaagaaagaaagaaagacagtactctttagtagctgctatgtcattgacactggagtggagcttaatcccttcctcaatcagtgctgtcttcctccttcaaaacaaacaaacaaacaaacaaacaaaacaaacaaacacaaaatcttttaaaagcttgccttgaaaatgatctccataaacccacatttaaaaaaaaggagctggtattgtgtgtttataatcccagtatgggggtggggggcaggcagagcccggtgctcactggcctccacagcaaagaatgcacaggtgtgtacaaacagagacagagagagacagagacagagagacaggaagaagaaactgaacgtttcaagtgtttactcatttgctgcttcgtcacatttaattaaagaatatatcaaggcatgtcacctttatggaaggttccttcactgagtatggtataagaaaaagaatagctttattgtgagtggattaaagttacagggcataggtggcttttaggggtgattttgcctttcaaaagctttggattctcaacacattctgcctggagattcccagtgaattcggaaacgttggcacttaactgtctcttatgtatcagccctgcttttgaaataaaccatcccaacaggaaatcatggtgtgtatctttatgtcaccaacaccttgctcctcccaaacattcaaaacttctaagcaattatggcagaagatgtcatgaggttatttgtgaaatcacatcaaaagtccctgagtaaaaatacacgcatatgaagggctggccaaggagaccatctcaccagactaagagtcagcctgtgctcccctccctgtcttctctcccctcctgggctcgaaagctgcctcttcttgtgtgaaatgccagtgctctgtatggtgttctgtttatagtggtttgaacctttttctgcccatatctgtcattgctgaagtaactcacctctctcatatcgactcttacccaggagccgcacagcagactctttgatgtaggtcttttctgcatggcagccaagaccaagtgtggttttcattgcatgctgcaacctcaccctttgggttgttgcctccaggttaactagatcctctccctgcactgcccatgcatgcgacatgcttttcctggtagcttttttgaatgtagtaagcactggacgcatgcatggaattaaagcagcgagcattcctatacactgaagaattgggatatgtaattcctctaggatattcttgtgggcctgcaaattgttgatattccccaaagccactccatggcttgagagctcaagactagagcattgggaaagagataactaagtctcatgttagcctggagctcactatcaggctcgtggccagggatttagaatctaaggtccattgctaagtagcagcttacctgatggtcggttctgtgccttcccaacttggcatgaatgtgctcagattgcccagggatcccaccacttctcgtggcttcctgaacaatgtttcctactttggtttgcttagatctgataaatatatcaacttaataaaaaccactagtaagataaatttctcccaagaaatacaactattttccttgcacatagcttattgtatctagcaataacactaattcaactttaaaatacataaaaggatagtactatagaggttattcatatttactgaaacctgttggcactacattcagcattattgattaataactgtgatcctttcttccccattgcaacacgcgttttactatagggctggtgatgactttctttaaatgcacttttcattcttttttattgttgttatgaaatgtctactttgtcattctgtcttgtattctctggatgagcttttgtaaaatctaattgctaggatcttgctggatctgtggatggtgttatttcacacgagaaggcattttaagctgcagacatactgggctgtgaactcaggaagacagaaagtagagtgtcatcaggctaagataataccacagtgggaggggaaagccccatagtagtagcttgccagtatagttaacactaaatctatgaatttttggcagttagaatgaaacaaagctgaagacctcttgcctctctggccctccctccttgaaggtcagttttcttatatctgggggcttggaagagttaaaccccttctaccctccattctattagacacatcctgttcacaccactgaagcagggactttacttagaatttcaaacgtgatctttgggtaaccactaaagaggtcctttgagtctgttttcctttctgaaaggagcagagatggaattaggggacggccctgctcagtcaggtgatgctgacccaggagtcaaagcactcatctttaggaggagagcttctatctaggcctcctggaaaggaacccgctgggtctccttgagaggctcttcagcaaagaaatagttccctttgttcctagaaacacacagcggttcctgctatagtgacagaaagcctgcagagagacagagagtgggggtgagaggacccaatcacagggcaaaggcaccagtcctgagaaatcagacctggggcatcctcagagcaggaccatgctgctgtggttttatagggatgcagaaaacaacatggggaagaatggcagagccagcaacagcactgcaaggaggagcagcaggaagaagcttgctgcttttagctcacaatacccctctccaaatttagattcaaaagcccagtgcacaccatccatctagattgtggtaagagttatctctatggcctgaagagataaaatgaattttgataaataaaggacttacagtgtgaaccagcagcaaaagggaaagaaaaagaaatatgaaggaaaagaattcttcccagagcaaaggcactgattccatgaagtagataaaagaacatatacttggaaatatgcttatatgagtatagggtttagtaagaaattctcttagattaagaggacctttggttctgaaggtaatttgtcccactgactgtccttttgttggtctctactgcccaggttgccttctgacattctgaagaaattactcccctttccttgcagtcagcagattcatgaccgctaatcagcaacatctcagactgtcctttttggctgtgatgctgtaggctctgtgcaaaattcctaaataggaatacctaacaaaacatccacgcctctgctgtcagccaaagacagagctaacacacagcttttttatttccttgtgcaataaaggtataattgttttctatgctagatgtcaataagactggtgccaggtctctcccaatgtcctaaggggggaaaaaatctccagtaacaaagaaccataggataccacaaacaaagctatcaccagccattagtgtcaaacaaaattcatcccaggctgggtgtatgtgttgctggttattgctttttagtcttcaaggaaaagcaacagataaaagaaaatgctgttacctgttcctgatgctaggactcctcagcactaaaaggttttgttgatgtcaaccatgagtgaactgctctaggtagtcatggttgagaggcatcagaattggaactatgctgtcagtcagtcagtcagtcagtcagtcagtcagtcagtcagtcagtcagtcagctagtcagcctgtcagcctgtcagcctgtcagccagccagtctgtcagccagccagccagccagccagccagtcagtcagtcagtcagtcagtcagtcagtcagtcagtgcatcagttcattagatgagcttttaacgctaagtccttgaaggtaagattagagtgaggtgacagtgccaaatgcatggtatcaaggacaaagaagaggacgtatgtagcaaacctgtgaatgacctccacatgtcaaagtctaacatgtggagaaggctcactaagaattgttttgatctctgcctataataacagctggaagtcatagttatttgaaaacttattatgtgacaaaatgccagcacacctggtcagactcaccctcccaggctgcttttggtgtgtagggggctcatgctttctccttccagggcactctccattttctatacaagtatgatgcccagctattttgaaactcttttctatttcagactgttttttttttttttttaatgaatggtgatcctggatcattacttaccagtgtgtagatgtagctgcctattggttatcactgtttagatatgactgcctatgaacctcttaggacatgtgtgagatttagtgtcctgagagaagccatgagaagagaaagcacagcgaattgatgaatcctcttactccaatcaaggacctcctgtccaaggagaatgttctcaggtgctagcagcctcctctaacccacccaccatatgccaggctctgtgtctgagtccccagctctttgtcttgatctgggatttttttttcttctgccttttgtttctactagttgccttacctaagatattccatttgacagatagaccaaaggtggggttggggttggagcagaatatatgtctgtgctgaagggttctggaaatgtgtgtgcacatgtcttttttgtgcctcctactcatacccatgtggctcttgaaccatgcccttgaggaggctccccacttgtatctggaacacacatctgcataaagatgtctttagtcctaattagacaatctctttatatctcccctcttctagacagatgagactgctgaaggggagatggctagggcccatggagttagagaagtggatgtctcgaatgcatccattgtcacttcacagataatttagtaaaaactgcagcaggcagctcttgtttggcaaaactctgtttttttatgtaatggcttaactctgatttattacataaaagttgctggcaaatatggacactaattccactctggtaacaactgtgattgaaataattgtagtctgtagtcaagctagagaaaatacgcattagtgggtaggttgtcttggacatcattccaggattccaacagtgagaaaatacatttatgggagcccagatagaaaagagtacttaggaagggtttggctggctcatttctctgcccctcttccgcatgcacgttacgccaacaggacaaacagagccaaagacctgggaggaagagcatccagcctcccgtgagccattcattaaagcgactcatggcttttgctgtcaagaaatcttgattaattatttagtatttatgacacagtatggctgcatgactctcatttccctatgttcttctttaatttttattccaaattaatatcctgacatatagaatctcaccatgtggtagtgagctctccaatcaagagcttactgcatgtcctgttgagtatttgaatcacattggtgtattttacaacgacacagtaatgtagacatatgcagagaaatggagcatgaacatcactaatgctttcaattttgttcttttgcatcattgcttctgggggcatgtcccattggcagttgccactgtcatccccactgtgacttacaagtattgttgattgaatagatagtccgccaactttctccttacaaaagcctttaaattttatgtctttatccccagtttacagacaagaaggtcaaggcttggagaggtcatgctaattctataacataatacaggtcataggtgatagagctaggatttcaggattgtgagtcatctttccaacttcacaccaattgtctattgctggtgaggctgacttataattccagtgttttgcttttaaatgattcgggtacatttatgcataaatgaaggtaaatataagcatagataagatgctcttatagtttgcttttatgttaccacccccccccaaaataaaaaactttgggaggaaagggcttgtttcaccttatagattatagttcatcatgaagggaatccaggacaggggctcaaacaggaacctggaggcaagaaccgaagtagaggccatgggggaatgcagcttcctggcttgctccccttggcttgcttatcaacctttcttatacagttcaggtccacctgcccagggttgacactgcctgtaatgggctggactctcctacataaattaataatttagaaaatgcctccatgacataccctttggacagtctgatggaggcagttcctcgattaagattctcctcccagatacatctatgtttgtattaagttgacagaaactacccagcatagatactgaattctttttttagagtgaatttaaaaggttctataagagagtagcaaggcttttaaccacctgagttttgtgatagcaagctatctgtgtgtttcattgagaaattcaatgtgtaaggaactgacatgttttgtctctttatcagcagtctgtgtcattttctttgtctcctagaagaatgctttattcttaggactaattactaaggtagacaccctgtgccatacaaatgctctgagatccactgcagtcattgttgttcaaagctcaagattacagagcacacaaggacccaacagagcagcgagggttcacatatctcccctctatccatccctgttcatctcagcacagtcccgatgatctatgtgtttattgctattgaatcccattttataattgagcacaggcacaattaaaagctgttgtcaggaagatgaataaattatcgacacaaaccatagcgaaggacttcccgacaaagccatttaacaaagtgagcttagatccatactgtagagtgacaatgagtgttttctatttacattaaaacaagtgcattgtcctttaagaaaaatgcaaagcaagtgcaatgcctaagaaaatgcttcaagtttaaacgaagagtttatttgatataattatcattggatttcatcaagtattgattacagcccatctgtcaaagagaatggtgtagaagacaccttccttaaagatgttcgtggatgaagtcctaatatcagtagacagaagagacttgattctgtgtgctaagaaagaaatataaactatactacttaccaaatgtatgtcccaccctgatattagaaaggtaaacatttttaatttagatataatacttttactttatgtgtctgggtatgttgcctgagtgtatgtctgtgccccacatgtgtgcatgtggtgttgtcaaagcccagagaaaggcttgatcctctgtgactggagttacaggcagttgttagctgccatgtgggttctgagaaccgaacccctgtcgcctgagacagcaacaagtgctgttaactgctaagtcacctctctagcactgaaagataaactcttaagtgtatagctctgagcaggtgcttaaaggggggtactaagaaaagtaaaatgatacaaagacagatagactgtgggttgttccaggacctgggatgctgtccagtttagaaggtaatggtccgcttagagatgtatgctgtctcaatgattaattagcatccagtcactcaaactagttccattattcttacaagttcacaagatatttttttaatatctgaagttatgtgaataataccactgattataggttgggatgcattgcaaagacttctttctcttttaaaattaatatagactggatagtcaggtacattttatcctcattagtaaacaggtagagtgaagcactcatcttgaccgaaatatccagacaccgccaagataaaacttcacattagtgagatttataccctccagtggctgtagatgagttctataatctgtgtctaaatgttttcatcttttttttttactttgattagcaaaaatggcatacaaagtttattaaccctccagtccatagttaggaaggagtattgaagaattcaaatactgtcaagttttatgatatgttggacatagtttagacaggccagtttcctgtagattctctcaaacaacccctcaaacacatgacttcttacactatggcagtctgacctcagcagtccatcagaacacccaccccttgttttcacatgagtctcttgaaatgctctgctgatactggatactgtgtcttacacacctccccttctaaggacatgacagccgttctggaaaggtagcgtgattttacaataaagttgcttgatcctcatcccaacttaaccccttagttatgtgaacttgggtagatattagactctctgattttctgctttcaaatcaaagaattttagcaaaatacacattttatctaatccttttataaggatcaaattcatgaatattacgtaaatgctatacagttgaagaagaattgagtgtggactgaatgaggcactttctgatctagagctgtataaagtcacctgtgaaagcctggagagataacaccgtggtttagagcactggttggtttcccagaggatctgggctcaatttctagcacccacaaaggcagttaataactatctgtgattctagtttcaggagagctgagcccatcttcaggcctttacaggcaaagggtgcacatggtacacagatatgcatgtaggcaaaacaccagtatgcaaaatatatatgaataaaaaaatttaaagcatatgtatgttccaacatccatttaaaaaaaaaaaagaaagaaactcagagatgaaagaagatctgtaaagatgatgagtcaagcttttaggacttcagaaagctgtctgaagtctgaacacagagacaagagcatttgaagaggtcacagcactagcgaagatttagagttagcaatattcaggtctcattcctgaaggaacaaaggcaccagcctaaagcaacaaagactttcacttatagcaagtagcaaaaaataattacattgaaaactcttgaatgaggcagattttggagtttcttcttagctgggcacggagttgatacttgaaacagaagggtcccttaatgctccatgaatgacatcttttaattagattaaaatagcaacattacagaggtaagctggaggagtagagtctgccatcattaaattttttgaatggactcatatccgcagtgctttgaatcggacctctataatcctggtggggattgagaaggccccattcaattttcaaaaggactagccttcaagaatggggagaatttgaatgatagaaattattgtacaaagggaaactttgtttcttgaccagtcccttccctattattatctggaatgcttgttgttgtgttccaaagctgcttagcatttccttattgcctgtaaactactgtcccctgcacccccctcccccatccagttccatcatttcccatgtaatctagaactgagaatgtactcagcgggtactctctgattgttaattgaatgcctactgccaaagcctgtaaggtggtgttgtaattatgtccctgtatgtttttaattctttccctcttgtccatatctgaaactgaaaatatctgttcaaagccttgatcttagcagttagttaagtggtatgcagctggttatctgagggtagggctcaaacacttaatcatctctgttcaggtttgaatgggaatcttcttgagcaatggcacccatagctagagcatagttgctagaaaactcctcagaagtagtagttctcgtagtggggtctctggacaagaacatcagtggaatttggaagattgggagaaaagcaaaaccctatatccctaatccagactagtaaatcagaaactccggagctgaggcctagcaatttttggcaaagttctccagatataagccaaagtttgagaaccgcagtctgagagaaatatcttcatggagttggacagtcaacagcaggaggtagaaaaacaagagttcatggatgtgagggtaagtatggatgcttaggaaaagagtccgtatgtctctctgggagatgatacaggattagaaaagatgggcgttgtggggagggcaggaaagccttgctttgagttttgaaaagttccaaagccaagtccagaaagttctatctatcaaatcctcatgctcaagggcagttacaggaaatatcattgtttagtagatggaagtgtctcctccagagacaactctatgttaaacatgtcctttcaagaagttcatatcccagccaatgtcctatattgcacatgtcctgtcagaaggaacagatcgtggggaatccttggaaaatcctcaagcttagattattgttcaacatactaaatgttcccaaggcttcaatatcatagacaatctgtatagacattagaaacttaggaatgaaaagtctatcagctaccaagtcttacatcctcaacttacccagtcactggtcaggcagaaatgagttaggtttggcctgattgctcctatgagagttataactggtgtctttcggtccttaaccctcttccctacccccagtttgcattgtatgttcacctaaaaccttcgctgatgtgggcctgcctcatcagaatggcaacctaaatttaagaatgtgactcagagtcattttcttttgtagttttaaatagaagttccatttccccactgccatctgcggatgtagacaaggaaactctgatgcttcacacaagtcaaaagaggcgcttccatttcagtttgctcctgcaatgagtattaatcacgaagagaaagtctcatggggagaaaaataaatcctgataagccaaccttttggttggtgagttatggattctctttttttaaaagatcaatgaatgccatggtttgtttccatttggggaatgaaataatggggctttggcactccaccctgtggtctctgattgtgtgagagcatgaactataagcactcagaggatttatctcagaagggatcctgataaatagttctgtcggcagttgagaaaccatgcagggtgttgttcctggcactcccaaggcagggagacgttgatgaaatggatgtaaaatatattctcagagtgctctggtcccacctggtgctgaggctcagttcagcttttgtctaagaattttcctcttcttgcctctcatcccaagcatatccatagctcagggtgtgttccggttactttgtgccttagccagaggagcagccattcaaaactgccacatgacttctattttactgtttgagttcaaagtgtagagctcagtgaatggttaagggggtgataattacatcagttctaagattgtaaatgaccaatggcaaggtctattatattttctctgttattttctgtgaagggagatggggagtgttcaggtatgggtttcaacatggcaccttttagattaaagccttttaattgttgcactttaaacactggacactatgagaaggaccagaacaaaagatgtgaccaggaaatcaaggattgatgaagaagagttgtttacacttttttgaatatcttatcccacttaagttgaacaaaaacaacacagtgacactaagctatcatctctctaccataatccagaaaaaaaaatcttccaaggaaatctccaaacaaaccacaaacccatggaattaatagggcctggagcagtcatgagagccctccgatgtcaccaatgtctctatcagtgactattgcgaaggcaatattgagcctattgcttggccttagacaagcaatcactgattttccttgatgaatttggacccaaggctttcctttgttccctatgtagaacgaaatagtgaatatatacttttagtgcagatgccaacttcctgctagcacaatccagcacatgagtgcaatgcttacctgcaaatctctcacatactcactcacttattcccttacacatacacacacacacacacttaattttcagcatactgcccactcaaggtctttgagatctgtaatagttcttacctgtcaactttcatgcatatctgtactcttgttatttataagccccactagagcttaagaattttacacctgtcccttgttggctacaggcccttgtttccacttaaatgcatgcttgtggtggtgatggtgtgtgtatgtgtgtgtgtgtggggggggggtgcaagctaagtacaagggtaggctgctttgtgtaagcttttgttcctgcctcttttcagcactagactaaccagattccattctgtctctcccttcactttcctgccttagtgagaactcggcagttgtcatttcctttgtaaaaagaaccgtgttctgttgcttttgttcagtgtgcttactttgtaaatgcaagaataggttattcttcctttgtgtgtggagggttaacacatatcgggggtttgggacacgacaaagggcatgtttgatttgtaatccccgtgaagaatggagaaagccagtgcatgtcacgtgactggaggttcctatagactgccctactgtgcctctgagtaggccctgcattcccaggctgcactgactcctgcctgttgaacagccaagcattatcctttgtaaggtacaactatactaactggtatccaaatgcagtgacttctaaagtggccttgctgctcagcaatctttcctgatgcacctctccagctcccactctcctagggggagaggtccacgttgcttcccatctgaacaaggatttggagatctctccatactccctccctttcgcttacctcgctgtcttctattcctgggctgggtgcttccatttgcttacagacagcagtatactggaatttcttttatagcttcgaggtgtctgtaaggctttgctgcttcccacctaatccaaactttgcgactcctcacatactgattctctgatcagtttgcagtgggaaatctcatggaagccacataccagtttgtatagtagtactctttggaactgcctactcttgaacaaagtagagtgctaggggtgtgcatttggctgcttggcacacacatgaagcccattaacctgcatgccaacaacaacaacaaataaaattaacccttagagtactgctttcatacattaatttgaggttttgaatcatattgttgaacattgcttttatccccagtgcagagtaccacacaggaagtccagtcttagttcagccaggacagtaaccaggatcctctcctacaaggctttcttgagctgttcctgggtcttttatgaatatactaacagcttttagaagatccagatgtgggtgctggaaaatgggctccacttctaatgggctggaggacatagggtttgttattttagccttgttatgagtcctttttaattgaagacatcagttctttaagggttaatatgaaatcaagacatttggtaatccttcctgcttgtccttcctccaaggtgtctgtctgcatgatcctctttagaatcttagatcaactcctgaatgatgatgaaaaacagtacataaaattatcaccaacccccaacgcaaagaaaagaacaaaacactgaatggttgaatggagagccctttggcaatgcttgcttgatggtcatggtcacaaggggtagaaagaccaaatgttgtattcagcgaacattcattttgtcctctaccccacacaccgtttcctggcattgtggaagctgtggcgatattttcttggccttttatttacctcttgctttttcttcttcctgtctaatagcccaatagaatcctgccagaatttctacaaagatttcacattacagatcgacatggctttcaacgtgttcttcctcctctactttggcttgcgggtaagtttggcagcatcttccagtagtaccacagtggggcatgagaatcctaaacgtatggataaccctccacccacgactgctttcctaggcaaggtgaagcctgaggtctctgtggtggacaagagacctgtgttctggtttagggtctgtggacaagatctacttagctgagagctttctgaaacatgggtttattttggttcaaggaagggtttgaagcaatggtacgctgactcattgctattcaaacatgactgtatttttttctattacaaagtacattgaaaaacacttaagctcacaaatgtatatttaggaatgtcgagactgcaattatcagggttaaccaggagtgaaggctggtgggacgtgggggtcaaggaggagtgaaggcttgtaggattagggagtttacactagattaggcttatggagattttttttgtgtgcaaaatttgaattgtgcacataaatgtgagtgcacatatatgtgctttattcatagttagatttgtatcagaaaggccaagaagctgagatgaattaaaccttctctaggcatctgttggaaaccacagaaaatcgcatcgcctgatcattccctaaggctaatgtggcatatagtcagtcacttcctacaaaaggctgtggattctccaaatcaagctagtgattaatgtacagaacagcatgagattaggtgaagagcagagtgtcgccccgcagaccccatagaaacccaacatttatcctttgacaaaaggacatatattaaatgctgacaccgtgcttctcattttgtttttctgtcttattttctctttccctccagtttattgcagccaacgataagctgtggttctggctggaagtgaattcagtagtagatttcttcacagtccctcctgtgtttgtgtctgtgtacttaaacagaagttggcttggtaagtcggtctcttttgccgtttcactggctcttcagcaggatagattaaagatatatagggtccaggaaggattcttttgctggtctgtggctatgcataggcagttttgcgtgtggccatggatgatgttcttggggtgtcagaactggatggcgacagcccaggagaatctgtggaggcagagctttagacggtatagtttcatcattgtttaagtcccgtggtcatcactgtcacagctgggacttctacagttcactcttatgtcacttgtcattcaggaattgagagtcaggactggttaaagaagcccatgggaatgagaccaaccgtcagagtggcaggatctcgtgccccagaagtcccacctgtcacacttgggctttatttatagttgcaatttctgggataagccgtacaagatgaaacatctcaagtggaatcacgggttactccactcccttgctgggagaatgttccttagtgcttggcttatcaggtcacttcctgaattaagaccagcacagtaaaacaattagtcatgaaaagcaaccagctctgagaaagattaaattgacagctcccagctcctccttgatgctgtgtctaagttataattaacatgaaaacagttttgcttccattagttaactgaggattggagtacttacccagaattccctgtctttacttgtaggtttgtttttttttattttggtttggtttggctttttaaaaaattaattaattaaattttctttttttttttttttttttttttttttttttttttttttttttttggtgctcatacgggacaacttatatttttcaaaaaaaaaaaaaaaaaaaaagccctgggattcacacacacaaaaaaaatacatgttctaaccattaaaaactttcaactaccaaaaaagaaaacagcaccaggccatttctcctccttttgtcctccatgagtccccaaacccccaccctaagatgccgactattaacacacctttctgcaaactcatctcatcccatgcataagtaaatggatgtgcacttatggccaaacattagaggggtactgatgttcctatgagaaattgtttcaaataaccatattccactgcaatttagctcttgtagtaacacgtggtggccatcccttcagcaccataataaggtaaattttatagccatttgggaaatttccgttatctgcttgttgtgtagtagacctagctctaggttctaatggatcgcctggatgttttgtttgctagcctgaacgatattttcataaacactatcatccatgtatttgtgaaattccattcctatagatatttccatattaccagaagaggcattgccaagtaaaagagcatgaataatttattttgtagacattgttagataatgttctaaaaatgttgtgggaagatgtacttgcatcctgcaaagccctgggtttgaaaacaactgtcacatatttagaacataagcatctctaatatataacatatagtgatcacctacacactcttggatgccttgtgtaattgtaccctcgtgtgtgcatatcctcagttagatgccacctagccccagatttctcattcaaaccatacttacttattgctgaggggaaagttttgcttcttggctctgagatgtgcttgctgagaatggtcagtatgtccagatcatgagagccacatgcaaatctccgtcctgagtaggtccatgggctggcgcatcccagccttctcagctgagctgacgattggctttgtgacctttgtgactgggtcttgttctccactcagtctgtgaaggacattgacagactgccgccttataattctgagaagggcaggaaccgagggactttagaaatcaataaatgatgcagcctcatgggaagcatcagtgttgaaactgaaaacagagcaatggcatgctggattataaaattaataacattaacaataacaacaataatagtaacaacaacaacccaaccaaaacaatcaaaagaacctgtccactcttgcaggagaaaacatttaatacgatgcttttgcttcttagtaactgcccttgggtggagtcccaaaccttcctgcctattacggaagagtcattttagtcaaaaactaggaggtccctctgtctgatttaatacataggttatcaccctgggaaacaagcattgtactcatgagccaccacagaaactaatgaacgttctcaggaaacagtcctacaaagatgaaaaggaccattaggtgtgaacagcctttcccttatcctggaaagtggaggtatactgccttcacactgactgggatttgggataagatagatacaagaaataagactactgaagtactgcacaaagttttgagggtgggggcatggtactgctggcatcatggtgattgaaaaccagagtggttaccaggggcctgatctgtatctcttacaatgcaccacccagaccatgttgccattcttattcttagcacaggattgcatattatataataaagcatatatatcacttatatatgtccgtttaagacactcagtaatacagccaacataacaatggtgagtattcaaatgctgcagcaatggtcctaccattcaatctgttacctaaatcctctcaatcttcagatcaaacctatgaggtaggaattgttaattacttcatgtttccagaccaggcacctgaagctcagagaggttgactctcttgtccaagttcacacagcctgtttggacaattttccccagtctgacatgatgtcactgcactcttttgctgaccttgagcttctgaccttaaccttgcaagattgggagctttgaggaccgatttgggaaaggcagcacccactctgctgcttgatgttggcattcctccatccccacttactcatcccacaacgctttgcctcgggccggaagggagggggagagctcttatttaagagcgcacactcctatatctcttctctcgcactcctcctttgccacctccagtttctagaaatgccacgaggaccagagaagcatacagaagtggcatggtgtctcccaagtttcggggcacttcgtcagcttgtagatcttgcagaggaccaagggcttccatgtgatcacactcagcagagagaagtagatcagaatccagctctctgttctgtcccagttcaattagctcttcctcagccactggcccacgggtctcttgatgcaagatcacacttacttgcctccagtcctgctttcttagtattatcccctgtaaaaggatggtagcaagggcggctccctcatagggttacaactgggctctagtgtggaagctacatactaagaacatagtgaaaactttgctagcagggcaatagctatcccagcctctttctctaacttttcctccatactttaaagtaccaaagaatcatatagagcaggatgggaccccacaaaaggcagcaggatgggacggcatctatgtctgcagacggcaaagctctgcttgttttaattcccattctcacacatgggctcatcccttcacaaaaatcctcaccccaaccactaaaataagtgcaccctgaaatgagaggaggattttattttgagctacgaacaacacgtttatctgtctgttcttttagaaactctacccccatgcgcggtcagccatgccacctttgtgcatgtagatgtttgtgtagaaagtcatctcctgtggttagaggaatggaataggagaagcttactcactgaccagttgcctgatgtgccttttattatcttagtgatagagttgaaaccctgggccttgtctatgctggacaagtgcttccctcccgagtcacagttacagccctgcctaaccaatttttattgagcaggtattatgtgcttagcactggcttgtgagtatcacagaaacagcctccctctttgttagctgtgccatgtttttaaacagattttacccatattctctctctgacagaatgaggagcgtgactggggcctccaatgaatggaacttatccattctaggtccaacagtagaccttaacaccttcaacaaatttcactagaaaacagaacactctagtatgaaatagaaaaatgagctagtggccagtcatagaggaaaacaacaacgaaattgaggctatctacttaaaaatatgactttgtatcctttgtgtgtgtgtgtgtgtgtgtgtgtgtgtgtgtgtgtgtgtgtgtgtgtacattctagaaaacaagaacaacaggttaaaataggacacaacatagttcctgtttgagactaaggttcaatcttattttggaaacaagataaacagacatgaaatggcagtaggtaacattgcctactatataattaagttcagaattgccaagcacagcagaaagcatgggggtgaggggtagtggtcagaggagtgagagtagcatatgcttgtgtgtgtatatgtatgtgtgtgtgtgtgtgtgtgtgtgtgtgtgtgtgtgtgtgtgtgtgtgttatgtatcagggatacagaaaattctgtggaacactgagccccagatgaggttggtagtggagggcagagcttgccatggaaaaggaagctcactccctgaggggagaggactgcacttcacagaatagtctgaaccaatggaagatagaaagtctttttcttaggctcatgtcagcctcaccaccataatagatgcttgtagttgttttctactgacatagaaacctatcaccacaatgttgtgcctcaacacagcctctgtgcctcatctcataattttttagcctggaagtccaacttgggtctggctagggtaaaataaaagtatcttcaagagctgggaagattgctcccttagtgaaaatgctttcctcataagcatggagacctgacttcagtccctatcacccacatataagtctgggtatggtagagtgtggttataattccagcaatggggaggcaaggtagatccctgggcctcagtgggcagccaggcttgccagtttggctggttttaagccaacgaaagactctatattaaaaaacatggcaatagcaactgcagaatgataccagaggttgttctctgccgtccacacatggttatacacaaatgcatacatactcacacatttacacacacacacacatacacacacacacacacacactggggtggagaaggaggaagagggaggaaaagagagcaagggagggagggagagaaggaaagaaagagggagagggagggagggagggaggatctggctcttttcctgaggctctgtaacactctaggcaaagagccatgccttgctgcttccatgtctataaccctcctagtccttgactcatagcttcttttcccaccagattcagcaaggttgagtccaggtaaaaactaaagcagaggccaagcgtggaggagtgctgcctgccagcgtattcctccttgcttgttcagcctgctttctcatacaacccaaggatgggcctcccatatgtgtgtgtgtgtaaaacctgacatgcttgcctataggtcaatcttatggagccatgtttccatgttttttctccgctgagagtttctcttcccaaatgattctagatcttgttaaggtaacaaaagttaaaaatttttaaaaatcataaaaaatgcaggtaggacaggtgtcattgtagatttgaaattagataaaattaagactcagttcttcatcagtgttacctacatgtcaataacttaatagtccctttaaatggtggttcctatgttctaaattgtatacataaagcatttcatcattctagaaagttctatctgctcacaatgctagtgtgtattcatgatgtgttagcaccatggctttccacctctccatggaggacacttctacatacaaaggagcttaacaaaagtttgaattgatttttaagaaattgaatgaaaaaatgaaataaaaaggaaaggaaaggaaagggcatgattgctcctagcatggcagaggagaaagtttattatagctatgtgggagagcatagtcagagacagacacgtctgggagagcccagagtagacatgactctgttctgtgtggggagaggagaggaagggagacaggaaagggggaacttgatacagcagccaggaggccaaaggtacaaaagtgacaggtaaccaaaccaaaatgcctggattatatagggaagagtccagggtcttgggtgggataccccagccattccctgtaacaggttaggactgagggatgctgggagaacccggaggcaagggtctgctttgacatgttgataagcatctcggccatttgcacaggtttgaaacttagcagtaagtctatcttttaaagaattagatagttctcctgggatcaccaagagggctcagtgggtggagatgcttgtcagcaagccaggactcattggtggagagagcaaaatgacttacacaagttgtcctctggtgtttgcacatggttgggaaggcaagtgtccaagcacacagacacacagacagacagacacacagacagacagacacacacacacacaattaaaagtaatattaaaatataaaaaacaataatttcccaaaaaactcaaaaacctttctatccagatgttagaggcacaagtctttagtcccagaactcaggaggcagaggcaagcagatctctcagacatctgagccagcctggtctacagagtgagttccaagatggccagagccatataaataaaccctgtcttgaaaaaccaaccaaccaaacaaacaaacaaacacaaaaataagacaaaacagcaaggacaaaaaaaccttccatgaatagatggttgagaaggcattagctaaaaatggctgttgagaaggaatcaccaccccacaatgctcaaatttagtcaagtacatttaaagccttgacatcctaagtgtaaatattacatattttattatatattataatatcttacatataacatgcatatagtatgtatacaatatacacattaatattttacatatatgaaacattgggtctgactcagagcctctgcttgtcaggctccctgctctggggtaaaatggccctttaggtgcagcaaagaaaaaagaaagctctctggttccctctacaggatggctctggaatttccgtattgagagtaagtagtgggttagagaatactctagcttcaagttcctgagagcccttcattagtagaggtaggctaaccttgaactcacttttcgatctgccatctatgaccataagacccctcctttatctccatcaagaggtcccagcactggaagggcagtccccagagccctcaagatcacctgcaccacctaccaaggtggcctaaattctagttttagtttcttcagtttctaagcccaagctttctaaccccctccctttagcttgtagctttatttaaaaataaaatgggggagtcggtccatgaggctcacatctgcaatcccagcagtaggagacctagtataatggcacatgcctttattcccagcacttgggagacagtggcaggcagacctctgtgagtttggggccatcctggtctatatagtgagttccagggcagccagagctacatagtgagactctgactcaaaaaataaaacaagacaaaagcaaacaaacaaaagttcaaacaaaaccaaaagacaaaataaaacaaccaacaggaataataaacagggaaaaggaacaagtatggcttctcttcttggtataagtacgccagtctttagggaagaaagaaaaagaaagaggaagaaagaggaatgtacaatctaaaagaaaagttgcttctatgaccaaaataaggctggatgtgttcatattgtgcatatgcgtatgtatgtttgttattgtgcctataattaataggagtaagtggtctaccaagcaagtctgagatgcatgtcatttcaggtccatttgaggaaaccaagacttgtagatgttaagttactaattgctgagaatcacaaagttaagtggcaaagccagcctctaaactcaggcaacccacctccaaagtccaggttcctcctgtaattctatgctgctgctcaaatgctaatcgcacccaactgttatagttacacacaaaaggagtaccatccaaccaaactgactgtgagatgcagccttcccttgttccagtgacctgacaaagccagagggaccttctaacagagtgttccacatggtcccagttgagaaaaaatgaggaagaaaaatagaaaactcagtcactatttaaagcctaaattaattctagttctatgactaagctggcttttcagagatccttctctttgcagttggccttgtagagtaagaaggtccattttaaatacatttccagattcttaataaaaaaaaatagttaatgtcattactgttggtctgatttgcaatggcattagagatgtgtgctcttttgatctaaatattagtgttcgccaaattcacatgtagaagcttcaccctaaacctgcatcgttagaaggagtagcatctagatggtgattaggtcatgacaatggggcacccagaatagtattactgcatatgttggtaccttgacccaaggacacttcaccctccagatttgtgagcaatacatctatgttgttataaattatccagtaaaggtattttgatgtagatgcttgaagggaccaaaacatagggccacaccctttgtttgaattttttgagagggaaagagagagagagagagggagagagagagagagagagaaagagagagagagagagaattcattgatactgtgaacattagtaatagcattgagactaaagtatgattaaagttgctaaagtgtggcgagataaataagtcctttgctaagctctgtctccatggttggactttgaatgaaggcagtcccagcaaagcagactggtgaaagtttagatgaatttcaggaagcagattgctgttctggtagctgctgtacttgctaaatctgctcctggagaaattacacctcttgaagagatttccagttgtgtccccttgatattgctttgtcagggatgtgctttaaataagatgtcctccgtagggagcagggattctaaatcctcatcgacttgcatggctgttatatgccaaattggaaataacttcctgaaatgaatgtcttcaaggaatgaattcagcaggaggttttcacagatgccagaatctcttcagatggttccgcttgaccggggtgttattagaacaatctccttgggcaaactaaatctctgggactggacatatttacctttgcagcatctaaaaacatagcaataataaaactctcaattcttccttgagatctaagcctgatagtctggcctgggtagtgaaatgggaactgagaactgaatgctagttagaagctcagggacagaatagctcttattcaactgctcccgtgtgttcccgtgacttaaccgcgggaaggtgtgcatgttgccttgtgagacaccaatgctatattcaaatgtgctcgttatgttacagttccagcaatgtgaaggaaagctagtatctgagtgctgagtgggttacagggctctaaagacaaatggtttttttccctagggagttagaactgaagctatcaccaacatgcctgcagacctggagacttaggaagtgaaaactgtcaatctaaacctccacaccttgctttcctaaagagagaatgaaggatgcttttacaatctgtttcttatgcaggctccaatgaccttagcaggattttagaatatcctggagaacataggcacctcctactgctgaggctagactgcatgtatttcaacttgcctatataccaatcagagccaccagaatggtttcagattccctgaagaagtccagtaggcagccagcattgaggaatctctcacttgatgctttttaaatgagaggcacataccaaaccttaggaaaaaattttatacacacaaacatgcacacgcacgtgcgcatgcacacacacacacacacacatacacacacacacacacacatacacacacacacacacacacacacacacacacacacaccttctaaaatctcttgttagaccctctagagacaagtaaggagaatttttatagagcacagatgaacatggatggatattctagaggactgcttctgaaacttcagtgcctctcagaaccacccagaggtctggttcaaccccaggtttaggcagtgtgtgtgtaaggcacacatacagtgcgtgtgtaaggcagtgtgtgtgtaagggcagaggtagagggttttcctatagggtcccagcgacgaaggtccagaaactgtgctttgaggtctgtgggtccatcttactaggatgtcgaacttgaattctagaagtgtctgctatgccaactatcaagattctcttacttccagaaaccttgctgttttaggcttccagatgtcaggttttacagaaattctgtactttggggactgaagccaaagcattcacatattgagatatatctagtatattgtatcccacgttataacttcaaatggatcagttaagcccttttagaaagtcttcggtttccttctgtgcagttccctttaaagctcctccaagtcctaggttgcagcaagaggggatccctggctcttgtttctttccacgtttggttgatgctcttccttcccaacctcctgagattgggttagggccagctcgtggcatgttggagataacagagagaagactgctaagggaggttccagactcacttcttttccgttctctggggtctgacctgtctcctctgtcaaggatagagccccttagactgccagtctcgggaataggtcttgtatggccttattcctaggataactcattttaactagctttattctttctactttatcttccctggagataccttaggcctggagatagaactgcatggtgggtgatagacacctatctccctttccctaagatgtatttgttattgatgaagtttaatactgagataagtgactctttgattacatatcagaatcacagagttcaacttctctttctctctctctccctctctctctctctccctctctctttctcccccctctctctccctctctctttctccctctctctctgtctctccctctctctctctccctgtctctctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcctcctcctcctcttcttctcttgcccctcctcaccctccaccccatactccccatcccccctctttactctccctctccccctctttcttctcttttcatacgaggcactgaacctagggtcctgctcatgcctgtttggccatgaggatagatcctcgatgccctttttactctttgttttgagataggatggcactaagttgtccaggctgtctatgacgtcactaagctcagtctttgagtgagctcctccagcttctgctcctagggcagctgggattgcagccatgcacatagccaggctctgacgagcccttcttttttgtcaaagctccagtctttgtcttacactgtctacagtcccctttcgcttttattaattgcctttctgaggatctcttttcccagattccagctatctggttagcagttaccagttactaagctcccactctgcttgcccatatactccttctctatgacttccatagtcccccattactcactgcgtacctgaacttaaccagactagctctggcctcattcaaaactgtcagtcttttcattgtaggttgtctttgatggggctgcacatctacaagtgatgtatgcatgtccaggaccacaactgacccactgcctgtgtgtgtgtgtgtgtgtgtgtgtgtgtgtgtgtgtgtgtgtgtgtgtctgtgattatgagagagggataggaagggagagaggagagaagaaaagagaatgaatgtgaagttgatctctagttttactatttaggaaccatccacctggtttattgagtcaataggacccaggctcactgactgggctcatttgactggctagcaattcccagagattcccgtgtctcagcctccttggtgctaggatttgcaagtgtgagacactgtgtccagcttttttatgtgggtactgggaattaaactcattccctcatgttggtgtggcaagcactttttgaagtgagcaaccttcccggccctccactgtttagttttggaaataagattttattggaacacagccacactcgttcatttacatattgtcagtaatatggagacctggggggtcacaaagcataaaataccatttacttctttgctctttacagaaagcctattgatagcagatgcattatacattcctttgtgttcctctaaatgcctggcacagtgttttgcttataatagctacaaatcagttttgataaatgcaacatgaactttcctctgagatcattggaactgtaatagtgataaaacaaaaatgtgttttggcctctgctattataccactgtgcattacgtggcagcatcagcataagatccctatgtgtctgtctcctttactgttctacaagctctaatgataagtggggggacctggaggaggccacctgtcttactcactaagacattggcacagcaagaatgtgaactgaggtctttgcagtctcagggcctaaattttgaattattacttgaaatgtaccaatcagtcctagcccccataagtgacgagaaacagaaatcttgaaaaatccatttcaatgagctatgacacagaaaccaaacaagcataataaaggctaagacatgagtacaacaggggatctcagaaggaagggctcaagccttgtttcttgggtgtttcacctaactcacgctagtgtaaatccttcttttaaaatcctgcatagctgtgccattatcatgagcatcaattcagatgttcagtcactcgacaaactttaaagcaggtagaattataatgtgttagttgctgtactcagcttcagtttaaggtgtgaacgcgattttcctgctgtagaagaggagtacgcaaactcagacttcaaacccaaatacttatagggaaagggagataacaaggagatggctcatggtgctatgaaaccagtctctctagcaagggagagaggatgcttctcttcttaaagtggttgttggctgatctttttcaatgtccattaactaccattctttctccatgtccttctctgttttaaaggctggtgtgtgtgtgtgtgtgtgtgtgtgtgtgtgtgtgtgtgtgtgtgtttatgcttatgcttgtgagtgagtacccatgcatgcagataactgtagatgccctggagctggagttacaagcagatatgagctgcaagatgtagttgctgggaactgaattctgatcatctgtaagcacagcaacagctcttaacccttgagccatttcttcagtccccatctaacccctgcttctttttcttcctccttgtcagttatccttggtactttcctttgggaactgggtaggctgaagcatcatttatctgttcaagacaggtgacatcctggtgtcctatgtataggacttgtcttccttcttactgtatctgctgtccagaatctattaccaaacctgtaatgtggtacctgctggcagtgccaatcaccacacatcatatcacctcacatataattaaaccaacaagcatttgtattaggatgagtaaacatttttgatgaatttgaagacagggtcaaacacctttcctaccccccaaatgttacgagcaaaggactcattatctgaggacctcttgttcctggtttaacaaaatagctttgtgtttgttttatctaattgcagttctccttattcaaggacaggcacttctcatctggcaggaagagcaaaagcttggctccaccagcctcctagaagtcttattgaagatacaggaggcattagtcctctggtgcattgacctgcccagggggagccccctcttcccgcagcccaggctgttcccagtccctcacttcagctctgttgcatggtccacacctctgcatctgttaagccattctgccatctagtgagggaaagcaggagtgtcgtcctgagaagcctgtgtcctttgaatcctgactgacaaacctcagatgaaactttaacttttagagggcaactcaggagagtccccagcctacaagaatccctccaaaaaaagaatagagtaaaagacagatagcatgtacatagctggggttctgaaagttggcccttatgctcctgctgagcacagactggcaccccaaccacccacccccatctctgtctaaactgacacacaagggcaagtattttagactgattccagattaaagattgcacttgattttactaaaatagatcactcttgtccaggtttgttcagatttaagtcttccttctgtctcttgacagaaatggtttggagcctgaaagaaatactgtggtgagctaggatgtactaggatggagctgtagtcttttaggtgctgttatttcaggtattcttgctgggagctgtgttagtgtgcaattattattgactaccatttggctaggtcccaaaggtctcctttgtggaagataatggtacttttcatagataagctaacggctgcataatacaaggcaaaaaaaaaaaaagttgtgaatattcttaacctgagttgtcaccgttcctatcaacttgtttataggagaaagaaaacctctttctgctgctttgctcattgtctctctctttctcacatacatagaaacacacacacatacacacacacacacacacacacacacacacacacacatatgcacatgcatatgcacacatttagatgctagagaccctgggacctggggttcagtccacttttctttgaaatggtctcttatgaaatgaggagtgagctgggtgtctatctatcccctgactcctcctcccccagccaacagctttttaaaagagtgttctggagatttaacgtggctctccctgcttgtgagtcaaactctttccccactgagccatctcctagacctgactgttacctactcccggtgcctgacccctgcattttgattggtttctttgaccacctgcttggtatgaagtgagggaaaagaatatatttaagatgaaaaaagaagtggcaacaaaaagggtcagagccataacccaagaagaaccttctagattcatctctgttatatgggatatgcgtagctttccagggaaatgtactagagtacagtagttggcttccttattccaggaatcccagcaggaatcctgacataggtatggttgtctggggagcatggtaaggatggctgtaaaaccaagaacatgcaggaagaagaaaatcaaatgccttgtgtttgcaaatgtacttcattaagacaactttcctaaggtctagatagcaaaggaaaacatgtgcttccagaaagacatgggtgggaaaagattcctgtacgcaggttttggggctccttatattccagaatgtgtgtgtgtgtgtgtgtgtgtgtgatcagtcacatctgcatgggagggagaaaaagggcagagaatgctgttcatatgtttgtgaatgtattttaaaatagccatctctgttgaaatagcaactcagaagtgtgagcggaggggacgtcttcctgatggctagctctaacaggctgattggagaagtcagtggtatctttccccaaatgccaggtgttcagcctggccaccattcatggcaaagatcttgagcgaccttggattaaagccccaaggttcattttgtctgtcatcagtactgatttgtgggatgcactggcgtggtctgccttgccttgggcagggttctctctgttttaatcacacagctgggtggtgtactgggacatctagaaggtactgaatgaaagccattgagtgagcaagggagtggtaggataatcagagagtccatttcctattctgtaggacagaaatcagcaaatgtttcctgtgacttcccaggtagtaaatatcttcaactctgaagaccatccaattaccattaccacttttcaacctttcactgtggcctgcaatcagctccatccaatatggacttgaatgagcagtgtgaagtatataattatataaaaatgtccataggtgatgttataccatattcaatgaatacgtacaatgacaattaaaaatatattcatgaacatttaagttggaagtttgtataactccaaggtttagaaatcatccatctgatttttaaaatttatttaaaaacatgaagaagtacattcttagctctcattctgtgcacaagctggtgatggcctgcctggatgtgctcccatgtcatagttcacctgcccttctgtagaggattatatacatggttaggttagagactgtatggagtgttaataaactcattcatccactcaaggctttattgaatacttttggtccctaggcactggatgtaccaacagacttctgattagtcaccagcccgaggaagaggtccttatctttgacagctcaggcctcagaagtatgagtcacgacattgtagcaaataagaacccctcagtctaatgaatgtgcatgaaacactttaacaaattagccatttctacccagtgcctgccatatgttgccagcatctttctggcagtccttatttacagactggaaaatcggtggagatggagtgattttcccatgacctctaactcagtctcatgcctaacaacttgctgctggttctagcatattggatgctcactcaagagttctagtgggctttcagatacctccccttgaagatcaggaagacttagggaaaaaatcttttccccctcatttggccccattcttcccattctctaccttgatcaaaaccagcaatgaaaacaattcctctctcaggattatagtctgaaaacagtgaattttttttgtcttgtctatttcatttcctgaaaacaaaaatagcctaggaaactattaaatacaacagaagcaagtaagattggagcattggaaagctttgcctcatgtttttcctgcttgtctgctttgggcctgccttacttaattcaataatctatgcagcttgagctctggctagcaatgacttcctctgccaccaacaattttgcaatcctcctgaatcctttaggggattccaaggcaaatggccttaaacaggaacttaattgtctgagagattttatttgcttattagaacagtttggtccacggcattatctgtatggggaataattcccttagctgcatcaattttatagtttctagctcattggattgcagtttttcctacataaaaggatgcctggcatggagccacccagagtgacaattttgggtgctttttatcacggcacaaagtaataacaacgtgagcagcactggtgtctctcaagagctcaagaagaaggcaaaggggaaaagggcaggatttagagatgtaatttgggattaataaatgattcatccaaaagatcagtattgatcacagctctatggttgtgtgtactgtgagattgtaagacacagttcagccaggaataccctgatctagttatggatatgggaaatcaaagcaccacgtctacaatgggaatttaacatctggtgagtgaatataacagagaactgataaagtattcaatagaacactgaaaaccagacaggagaagttgtgcatttaaatgcagacatatgtttgctttggctataagccatatgttgcttgtgcaatacataaagatatctatgcatgcacataatagagtccaggttggtagaatagtaactggaagttggaatcgtgtacttggctttttcttagaccatggagtgattggcacaatgagatagtcaatatcaaaccaaccatctatgagactccaaatgaagaaatcttacctgccttgctcactatgctctgaatgaatagtcaccagtaaaccaggtggcatttatctttatagcccagactcttcctttaaagaccatgatgcagacatgggtcatagagcaggcagacactgtttccctcaagttagcagcactggtgtctttcaatggagggacgagggaggacatgaccagataaggggcccgataatggggaaaggttctcaggttacctagagcttccaatgagaagcttaatctagacatttgtgcttatgtgtagggaggtaggtaatagagctgtagtgtttctgccaagagctatacctggttatattcagtggatgaaagcatcatgtggagagtagacaatactgataactagactcataagtgagagcctgggggtcagctcccttcatgtgtagttcccggtgaaagtgaatgcagtcctaaattatcggttgttgagtctcctgcttggatctcttcgaattgttaatttgaaagaaggcttggtgccaagctgaagtggccttgataaccaatagaaatcaggggtcattaggactgcttgagtctacttaggaacatttataaagcacaaagcatccacacagacgctccatctagaaaatcttttaggaaaaccattatagtttgattggcgttttgaagtgggtgtcattgttcctttgatttggcaaatatggacaaggatgttttaagaggtgattagaacaggaaagtatacaactagtaaatagcattaccaagtctatcactgaaggcctgataaactggtgaccttcttaatatgccacaagagctagaagatagccctgctctgccagtaagaactaagcatatcttctagcgcttctagtggaatgagttattatctgcttttttggccacaggaattacatattttaagttgaggatgtattaatgtacctgtggatgtggggacttctgggagaggtagagtttaattgagccttaaagcatgggtaaagaaatggaggggcaaagggggacatggcaagataagagaaaaattatacatgggagaagcacctctcttgggctatataggagattcagtgagtatgtaatccacacttttttgagtgcctatagagaaggtagttgatagaactgcagtgttacttctatgaacaggagtgtatgagtctgggcaggcctgtctgtgaaaatcactggagaaaaatggagacaatttcagtcattatctaagacttaatgcagtattgaggatgtagtagggatgtgtctattgaatggtccaagatgatctaaagtgcagtattggatgagtggacaggtaggagagttccacctactatgtatctacagaagagctttcaagtgagggatgtaacagtttcagagaatggcagggcaggactagagagcaaggacaacagagacagccagggtcctaaggaaaggatgagcaaagaaaggcagtatttggctgggtggacacatagattctaggacttctcttgctagagaagaacaggcagatggaaccaaatgctaatgccttccagtgaaccaaaagacgtaaaatatgatgagaaaacaagaaaataggtgcaacataggttgaggggaagcagaaggcacaggagaatgtttccatgtcagacagaaaaggaccatctggtccaaggtcatctctacatttccttaggcaagccctgggcaggaatgatgcagctctgggaagctttccaacttgaaggccaactcaaagcccatccttctcagaagaaggccaaggaaacatctatccaagactagatgcccagttatttagaaaggaagagaaatgaccacaatatgctgcagagaaaagaagtgatggaattcagaactgttgttttcctaaaacagaagccagaaatgaactatcttttaataactgtcttggtattttattctggggacttaggaaagggggaaaaagtgtatgagaataccttcagaccttggatggtttatggtaatgtttgaaattgctggtaaaattatgaccttgtaatttacggctgtgtcatatattccaggccacagtataatttatgtacccagccaggtcctttgaaaatgaataggggggagtctcacataatacacagtttataatgttgtgctgttcttaatgtaaaatatccttggcttaaacatgttgtttaatggggtttattgttggtccagggtcattactgaagtttctgaagaatagggtggggttttaaggaactctaataatgtggtcatcttcgctggtggggctgctgtactcagagtactcaagcctctctctttccctgtctgtatcaccccaaaagaagtatacaaatccttctcttagtacaaaaactgggcagctagataagtttggccttaacacaggctttaacctgatcaaaaacttaacttccttaggaaacaaaacaactgttagatactacaagtggctcaaaccaagctccttgcatcattttgacattgaccccagttagagtactggagaggaaagaaactaggagctagctaggactgctggagacaggatggtaggagatcttacctccctgaaaaggcagaaggacaagagaagagagtgttctgccctgcaatcaagagagagaagtcccatgtctgaggctcagaacctccttgagggccaggttatagagccaccactctgggggtgatcttggacagcaacctttcatcctcatctgtaatcaaggcaagcttctattctttgttacttaagggaatcattgttaggatcaaggaagagttttgtgaccctgatccagtgaccagagtcacctctttcctcttcctatttacttccccactaccaccaccctgttacctgtacctcaataaagcttaacgacaatgatccgacgaagacctccttctacattagcctgttctgtctgatctcctttcggtcgttttagtcattctccactgattcttccttttggaaacctgtacccattcctgtcggcaccccaacccctgccatgacaaggccacctggttttctagatctgactttcgatctgttctgctctctccttgtctgcccctgtcttctaagtgccagaagtgttgataagaactgcagcttgaagcagagaaagagatgtgactgtgatgcagtgaccagggccccagccatcttggaacaggccccaggatactgttcccattaaaggcagtggagcttggaggcactgcagccttgtgcttgggagttcctagtttgtccactgagctgtggactttagcttccctcaagggaaggacaaggggtcaagtgttttgcttgattcataaaagtgggtccagatccacttagctcaagttaagggagctcttatttggttccatgtcttttattttatacagttagataagcctgggcatcttcaataagtattttcaaaatactattttgtacttttattttaaaaaaataaggaaagaaatggaagtggacacaacaaacaataaaaaaaaatgattgtatcacttggagatgattgtatatgtggaaagagaaagaagtcaaacaactatggcccattcttattcatagtcctagcacttagggattggagggaggtagacaaggcttagaaggccaactttgacatatgagaccctatctcaagctgaaaaattaaacaagccacgcattatatatatataaatcttatagtatattgtagtatacctggtttttagaagtaaaaatgttaaatttgtttccttgagcatagaaaaaaaatagagaaataggaattgctagttctttgtccttaagacattgctagtgtggttgtaagaaagcacttcagaaaaataatacagcagagccatgttttcctttaactgtagtgtttgctccactatggtgtgggtggacttttggctgtgaatgaagagaatatggatgtatttgcctttcctgcagctcctgcccctcatttgctaaccatattatcttctttactttggtcctataacctccccttcagcttctgtgatgcccattcttatttggtcttagcaaagtctttttaggtgtccagcattcaagctaggtatattttctacagcatcttctactgattccacttaactccttatggtggagaacctccctgaggacaaaagtgcttgtcttaaagttcagggtcatgaaggaccatgtttctggagcaggatgaaagaagtagcctgagcagtaaatgaacatgcttagaacagggcagaggtcagccaatagcctctggagctggaccatgtagccttgaatccccttttcatcccctgatgtctaggtagctgtaagaaatctgtttcctctttctctgtccctcctataagatgatctaaaccactgtggtggtttgaatatgcttgtcccagtgaatggcactattaggagttgtggccttgttggagtaggtgtggccttgttggaggaagtgtgtcactgtgggggtgagtaatgagaccctccttccagccacgtgggagccaatctgttcctggtttcctttggatgaagacgtagaactctcacttcctccagcatcatggctgcctggatgctaccatatttcctaccttgatgataatggactgaacctttgaaactgtaagccagccccaattaaatgctgtcctttgtaagagttgtctttgtcgtggtgtctgttcacagcagtaaaaccctaactaatacaatcacctttcataagatgttgtgggggataaaaggaactgtaaaaagtagactgaagaagggttcaaccacagtaagggtttggtgattactcttcattcatgtactgggctttgcatggcaggcattagctcattgtgtagtcactgaatgctgcctgtgggcctcctataggtcatgatctctaaactccttaagcaagaacaagatagaggtaatcagtgactgagcagcacattggcccctggcccctgcaataggaaagccacacacatggacatgtacagtcatgtgcagaaacttgctgcctgctacagttccctgggagcctggtgcttcagttactcctgatgacacttgtgtgcaagcaaattctttattgctgctttaaacgtctctcctttcacttcctcattcccttcctggggcccatgagatcgactccccccaaaaaaacataattagagctgtttttttcaggttctacttagtgggggcaggcaaactgcaacatcccactttctaaaacaacaactatatatgctcatactctcacgcacacagaagggaagggagagaatccagaaggtctctgtatgtaaatggtagagccaagatttcaatgtaatcaagactccaatggagtacatatttcatggcttttgttatcccaggtaataaactgacaaggtgtaagagatgtccttgaaccccttatctcttgcaatatacagaaataaacagttccagacctgtcttcgcccttagtcacagtaaccgctcagttccacaaactgtctgttgatggtgatggagattgacctcttttaagaccgggagtccctttctggatcagacttgtactgacctccatatgaggagttattatagtcagctcttttgtgacccctaagaccccaaggaagcaactcagcagattgattttgaaccagatttctgttcatgatacatgcaagagaaaatggcaagatttgccaatttgatgattttactgcctgggataataataattaagaaatcctctctcttaattagcaagtacaattagcatttctataaaacgatccatccacaaggtgaatgcgctgagatgtaacatcttgttcctgatgctgtggtgctggggtaagtgggatcattcaggaattaggaattctaatgagccatgtgcttcagccttcaagtacataggcccagctgggagggcagaatctgcagcagccaagagcaagtttccatgactgattcagtgctcagagaaggctcttgtttgttcccagttgcaaaggagccatagaaactgcaggtttatgggggtattttttttaacttttttttaataccttggctatgtttagtcctaatatttctttgtgggtcgaatgaccttctgaagcagagagctacagtgtggagaaacttgatcttgtgctagcttttcattactttgacaaaacacctaacataagggacttcaaggccaaaaggtttatttggttcataggttctgaggtcttgttgcatggcctgctggttctgttgcttttgaacgtgtgaggatgtagaacatctgtgtaggagcattcaacaaagcaaaactgctcaccttctggggactggaaaagaagggaaacaggaaggggttatggtctcaaaagccccttcaaaggcaagatctcaagatcaaacagccttccaggtgtctcagcttccaaaggcttcaccactttccagtaatgcctcatgttggcagccaagcctttagcatataagccttggtgctggggagtcattctgtaaaacggttgctacacaaaccttgggacctagtgtggatggatcccaggctccagggccaaagctgagtgtggtaaactcactgctggggaatagaagatgggctgactactggagttcaccagacaacttctcccagccacaggaacttttaagctatactccagatccaaactaccacagatctagaagggacatttttaggtcatctattaccaaaactctcaggtccctcctgtctcttaatcccaaagggtgcacagggctccttgaaggcaaggccttgagctgaagcacccctgagagactacttatttcctccagttgccatagtcaccagagacccccagtttacttttgattgtccttttatttcccttggcagtgctgatcaaagaattccatgcaaagacatttgaactgccaattgccctatggttttgcagtatctgcaggttttggagagctcttagaatacagagtgtgttgcaatgagtgactgattattattatttgctttgggggggggttactatttatacttctagagagacagcatcatgccttacagtatttctcactgagcagctctcaggaaaaaacttactgtgtaatatagatgctgcagcttaaggctgagcaattcattttttccagctccattgtatcctcccgcttagctcactgggtgtgaaatgcacgcgtgtttacttcctccgtgggtcctccttgcagtcagtacaatgactattaggcaggcatgtgatggaggaagaagaaaagaatggcctatttcatcctttaattggataatcagtccagaataatggtggtttgatttgatttgcaggcccacagtgcaggctgttggtaacacacacagtataaactacaaagtgagtgcagcggacatttacgcttgcagttccactgtggtgggaggggcggctccacgtactgagactgataaagcagtaaatgtaccttactcatcttcacataaatcatgaccctgcaggcattttcatagtctgagcccaagaagctggagtttttcttatctgtgagactcttcctgtcatgtgtaggttgtacacaaggatcaagagtcagtgccgaagagtgatccatcttcatcagtgggacaataagatgtgaggacatctaagatgtcacctgttgccacttgaccttaaggctgatgctcttgggcctctcccactggttccatgagaggacggaaatgttagtccctatcctcattgaatggttgaggcagacagatttgttggttaatggttaatggttaattgacattcctgacctccttgtacctagggggcagctaggatacaggatgcagtttgtgattggacatggatattttctgaggtagtgggtgtgaacacagcatcccagcagtgaaagaagctgcctaacataatattttaactgcttaaatgagtttagaaaatatttaataacaaaaggtgagcatatctcttttctcattcctaaaaaacttcatgtatttatttagagatccaatctgtgtcctgctgccccagctttcctagtgtataccagtaaacagagttttaatagccaattagtgaacgtcaccaaaaagtggatattagtgacaagagtaccgataaaaattttatacttactatatggaaaacaattgctaaaataagtacatgatgcaaagactttagaattaagaaaagggagttctagcttagtttaggatttaaagaaaaaatttatgcatacgttttgccagtgtatgtgtatgtacaccccacgtttgcctggattcccttgggtaggcaggagaatgtataagattctttaaagctggagttgtggatagatgtgagccaccatatggttgcttgatcctctacaagactgacaagtgttcataaccactgagctatttctccagtccctctagcttaatcttggctggagtttttaacaagaccaactagaatttcaaaccccacattttgagaggcagctacccattctttgcaagaaaccaactctcttttaacattttacattacaaagataacccgaaagcgctcctgtgtggaaatcagaagtaaagcactctagtccagcaggctgactgactctaagcaaatgcaaagttcctgactctgcttcctgctgctgatctcaaagtattcagcatttgcatgagtggaagttatttatatgcacctgagttgttctaggaaaattaaataagtgaatcttaggtgctattgtgagtgtttcaggaaaaagaaagagttaccaataggtgatcattcccaacatctttccttttttttccccactttcttttaattagatattttctttatttacatttcaagtgttattccctttcctagtttcccctccgaaaatcccctacccccttcccccttcccttgctccccaacccacccactcccattcccagtcctggccttcccatatactgggacatagaaccttcacaggacctagggcttctcctcccattgatgaccgactaggccatcctctgccacatatacagcaagagcaacaagtcccaccatgtgttttctttgattggtagtttagttccaaggagttctggggaaattggttagttcatattgatgttcctcctttggggcttcagaccccttcagatccttggatactttctctagctccttcattgggggaccttgtgctctgtccaaaggatgattgtgagcatccacttctgtatttgccaggcactggcaaaggccctcaggagacagttatatcaggctcctgttagcaggctgctgttggtatctgccatagtgtctgggtttggtggttgtttatgggatgaagtccccaagtggggcagtctctgtatggttgttccttcatcctctgctctaaactttgtctctgtaactccttccatgggtattttgttcccccttctaagaaggattctaagcttctgggctaatacccacttatatgcagtgagtgcatatcatgtgtgttcttttgtgattggattacctcactcaagataatatcctccagatccatccatttgtctaagaatttcataaactcgttgtttttaatagctgagtagtactccattgtgtaaatgtaccacattttctgtattcattcctctgttgagggacatctgggtttctttccagcttttggctactataaataaggctactatgaacatagtggagcatgtgttcttattacaagttggagcatcttctgggtatatgcccaggagaggtattgctggattttgtggtagaactatgtccaactttctgaggaactgccaaactgatttccagagtggttgtaccagcttgcagtcccaccagcaatggaggaatgtgttcctctttctctacatcctcaccagcatctgctgtcacctgaatttttgatcttagccattctggctggtgtgaggtagaatctcagggttgttttgatttgcatttccctgatgattaaggatgttggataccaatggcttgttctgtaagatcaagaatcaacaaatgggacctcataaaattgcaaagcttcttctgtaaggcaaaggtcttattctgccaacaagaccaaaaggcaaccaacagattgggaaaagatctttaccaaccctaaatctgatggggggggggggggggctaatgtttaatatatataaagaagaagttggactccagaaaaccaaacaaccctattaaaaaaaatgaggtacagagctaaacaaagaattctcagctgaggaatacagaatggctgagaagcacctaaaaaatgtcccaacatctttcttagggaagctgggagaacctgttgatccttagtcactcctttctcccttccaagcattgccttcatcaaaaggtgacaaactatgacttgttgactgaattggatccaccaacctgtgtgagggaataaatttttttggctcatagccaagatctttattttcatattttttgtggtcagtttttgcattcctaaggcaagactaagtagccatggttgaggttatataatgtataaagtcagggttactcaccatctgttttctctctctctctctctctctctctctctctctctctctctctctctctctcacacacacacacacacacacacacacatacacgcacaaacacacacaccactcgtgtnnnnnnnnnnnnnnnnnnnnaaacaccacaccaccactcgtgtgatgcacacacacatgtctagtttggattttctaagctgatggcgttaatgcagaaccttggaatacactagcaaagtcagccaggacagcacctcctgtcaaattgctctccgcccccaccagaggtcacgccatgtccatttcccaggttcgcctaaagttaattttgagcatcagaatgaaacttagcttaatcctatagtaaaccgggggcttttgcaaaatgtttcttctgacctaaggttcagtgttctgctgttctgctttcttcttcttcctctctctctctttttttaatagagaaagctaaatcaagagttcccacttggaaggatcacctctgttctttgtaaactgtaattgaagccataattcacccagctcctcagtctttactcaaagcctctggcaccgacgctctgcttggatttaattctagaatgaggttgatcgtttggtcggctttgtaggcttttcctgatcatgattattacaacccagtattcttcttccttgccgtaggtgacaggaggtgtgaggccatttcagagatgaacttccactatagactcattgtccaggcagggtgagaccagcgcaaagcaagggaaaggcctggatgtaagctttaaggaggctcctactctcaagactgttcaagtacagcgtcaccctgaaaaacagaatgcctccttcaattttgttctgaaagaatcttcttctcattcctctcctgattctgaggcacccaataatgtccaaccccccctacagttagaatgttttgggtttgtctttatgtattccttgttgctggtgtttaaccatgtagatatatttgggcctgcagtatgctcaagtccagatctcaaaaaaatctaacctatgggtacttcagtggcctcagatggccatctgtcacttataggtccaaatgttagtccggagggaagtgtagggccatgtgtcagcttcccagttggggctccctacaggaatcagattagaggggattattccacttcttttcttgatctctcagggcagaggagattgaatgagtccagacagttttatccccaatattacacacattatgccagtccccacagtgcctctcaggccattgccttggaaacggtagcaacagcaaggaccagcaagttggtgatgtttatgggcatctgatgaaggggcgggggggcggggggatgtgctggatatgatttgctagatgcttggttaatcaaggaggttattgttcaacagggaggaaggatagagcaaaggggaaggagagaaggaccagggagatgggtaagccatgtgactggagatggggcaagagtctcctgaatagttcagtcaaggattcaagagaagcacactcttccttgtatcctgagtgctgatcacacaacacaggtgctcggtccttggttttagcaagagagaaaaggagttgacccaatggcattgagtttgactgaactggaactctggtagtaagtcatagcataaggaatacatgtttggttataatagatgcagccttaacattcatgttctctgcttcaaaccacaggcattggttgactctttaattggttaagcatagaacttacttgccaacagcagataataggctatcagttcacttctagcttcagaattgacctccctccttcccttatagctttcttcctttatccacattcctctcccactgtggtcaacaactctcagaaagatgtttgcttcagtggggactaatccattgagcacctgcaagggactttggagaacaggagtgattatgtagcatgctctatatgatgagacatttgaaaacacatatgagatccactaatcatcacagtcttgtccttagaaggatgatgctgtctttagcagtaaaaggtttgcaaatgtcatagaaccagccttcagtcccaccgaggagcagagctggaattcagtataattgtctgaccctagatgtacctcctgcataataccatctcttttgaagagtatcagtgaacattcaaggaaagagggctaaggtggatattcccttaaagtaaaactaaaggtgagcatctttgtaacaagatacctgagatcactaggcttatttccagttcacagtttggggactcagtctatgattcattgctttaaggtctgtgaagaggcaggacactgtgtcatgagaatgtagcaaaacccttaactccatggctaggaactattaggaagaagaagaacctagacagtgtcctatgatccccatttgtccccagggacctaaagacccctaatcagatgcctacctcttaaaggttccattgcctccagtaatgctatcctgagaaccaagctgctaatacatggatctttgagggatatctgacatctaaactatagcgctagcctagctaaatacaaagatggatggtaatgttctctacaagatgggaagctgcttgaagactaactatttgatagcaattcacatttgtatccccagcttgtctggccccatatctccctcatattaccaacagcaacaagcatatctggaccacttgtgttatgtgccaaggatgattgtgatggatggtgtttgtttgtttcctaaaacagctctactgagctactttgagttgaagaaatgtgccatagtttattcccaaatactagctgtgctggagaacttttttttttttttttttttttttactaatgttgttgtttgttttcagtataagatttacagatattgacctcagggctttgtgtgtaataggcaagcaccctactccttggttatatccctagctctgttaattatttttcttttattttgacacagggtctcactaagttaccaaggtctctaatttactatgtattcctggcaaaccttgaacttgtaatccccctgcctcagacttttaagtagctatgagtatcagcctgtactaccagggtcaaaccaaagctggaatttacatctcttagcccagattttaagcctttcctctttttttcctttgaaagatttttaataaaagacaatctatggttgaatgaatgtaccatcacttttacatggtctgggcatactatctagtatgacttcattgaggtgcccaaccatatccgaatctatttcttcatcaacatttttcaatggatgaattaatatccttctgttcttttgtcatgatcactcatctcttaaggaagcaaatctggtgcaaaagtgaaaggctgggggtttctatgggtgaaggtcaccattgcatgttagcaaccaaatgctttcagcaacaaggcctcttgggactccctggggaagaagactcaggatagtacttgggacacgctgggaggaggagtgcaaagtccgtatataggtcaagatttgggttttgattcttcgctatcattgttattttcttctatagatccatgctcgagagaggagccatcactccttgtacattttcctaggacagcgaagttttgattaagcattcatacatttgcttatttgattatttataattctttttgacaggttgcccaggcttaatccaaattcatgatcctcctgccccagcctccctagaaccgagacagctggcttctccctctgggtcctcccttttaagtttcaagacactcagatttatcaaggagtttctttgttattttttggttgtgtgttttgagtctcagactggagattaggtttgaaaagcttttatggaccatgtgcccaagatgacatgcctccccaatgatccacatggcatgagcggctccagatgtcagtggcattatcaaactgaaagactcgtcataggaagaagccagagacttgcctcatgggctgataagaacttgtgctgttgatagcagagcatcatattgtccagttatgacagagcttttgtgaacagcatgtggggtcatctggcttgaccctagagccttggtgtgtagacagaggaaactgctgggagtaagttcctgggtagggaacagtgcagttctccttgtatttaatctgcatggaggatgttgctttatttcagtgttagagtgcttgtctatgcaaagtcttaggtttgatcactggtatctccagaataaaaagcatttaatgtatatagttatgtggagggggtgttattgcctaattttacagccatggcaatgaattactagttgtatctatctacttttattttgtagctctgtaagttatttgatatatcagtttatgataaatattatctcatggtttatattttaacaagttttgaactttattaaacatgcagatcaatatatatcatgaataaataatgccctcaccagggtttggcattctggttcttctgtctacatgaaataaattgtaacattttattttcgtctgttctctgaaagaaaccattaagaccagtatcattctctccaaaaacattgagagatctcatcaatagaagccaattcagtcaaaacctggtttttatgagtttgcttccaattggaatttaaaattttaaaagaaaaagccctgctgtttatgtcttcacttcttattgtatcagtttgagaaagttgtacttttacaggattttacaggagcataatcctttcatctggctgtcaaaacttgtatatatatatatatatatatatatatatatatatatatatatatatataatgttcttcatatttttgtattattccctgagttcccataggacttacatttctgtccatcatttctgacttccttgtgttacaaagttagcttcctgtcatttttatgtcattttaaacacattgaagattttttaagccaagagagcaaggccatttcttccatcttcaaggtatttgttatgctcctccctctcttccaatccctggtccctgcctatttatgtatgtatgtatgtatgtatgtatgtatgtatgtatgtatgtatgtattttggacagactcttattgtgtatctttcgctggcctggaaatttctatgaagaccaagatgggccttgaactgacatagatctgcccctgcctctgccctgccctagccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcatgctgggactataggcatccttggctttgccatctctattcaactgcctctctgttacttaatcatgatccagaaatagtgttaagcatcttctagcaggcacagcacaacatgttccacatgcacacacatttatgtagcatgcacatatgtacatactcagaaccgcaaaaggaagactttaagcaaatcattaagtaaaccacagtgtaggaagcctttctgttctcttctctcctgtaatttgatctctcctggacttctgtgtttctttatagattgcacaatcgctcaatatccaacataataccctgtgtgtcacaaatgctttacactcagtggttaggtaaagagctaacctaggatgaaaattctatgtggttattttaactctcccagaggtctggaaacagtgatggggaccaattgtggtaagctacagattctaagtatccccctgtttgaatcttagtgcttttccctccgtggctgctgtgtttctgtgtacactttggtctggagatatagatgcagtctccttgggttgctatggcaccatggactagctggctcaaagagcacagacttatttccccacatttctaggggctggagtctgaaatcagggcaacaggggaagggcttctcacagagtgctggaatggcagaagggaggaaggaataccctcaccggtgtctcatcttaaaagggtgctaattacatcctggacgtgcagccttcgtggattcaggcaaacccaactctctccttaaagccagaacctgtagatgctgcctagttgaatttagagcttgagcatgtagtttaagggagagagactgaaaccaagactaggttaataagagagccggtgctgaggacggggggtgttggggaatgggttaggtgcactgatggggcgactctgctcactgtcctctggcaagcagagtgccttcgaagaggattttcataattgagttatgttggtaagaggaaggtgtggcagaagagttagagtcttcctgtttttctctctgtgtagcacatgttataaagaagtcctccctatgagccctccgccagtgtcaagtaaggtcactcacataaaagaagtgacttggtgagccctaagtggcagcccctctcacaccctgttctgaagcaactgatttgagggattatagccttttccttttcccatcccctaagccatgtccaaaggagcttacatggtaattcccaggatgaagctgatggatagataagcttgtaggacataacgtgtgggagcattctcccaccctctctagccttcccgatatggctggcgcatctgagtccacttgcaaacgggttggtggtaggagaagtcatagatgctattgaaacacactgtgtggggcaaaagaacttgtccataggacaggtcagaggggcataaactccttccatatctttcaagaacatcagcttgagcgtgaacagatctaaagggcatctacagctcaggcctcctctctacctctgccatgatccccagtaaaattctggtataccatcacccacccagcagcagcaccacagaggtgcacactcctagcaggcgtcgcaggaagtctctgggggatttgttccacaaaggctacagagtgaggtctgggccagcggctcctgagaaagaagaaccagagaacttctggcagtcactggtggcttgcagcagggtttgtgcttcatggggtaaggttcttcctagctatagtcattctttccaagtgtaccatattcccagaggcattgcccttccacggcacagcatttaaggaagtgttgtggtgtgtaatgtgtgtatttgtgtatatgtatgtgtatgtgtctgtgtctgtgtgtaatgcatgtgaatggtatgtatatgtgtatacacatacacatacacctgtgtgtgtgtgtgtgtgtgtgtgtgcatgttcatgtgggatgtatgtgtgtctctctgtgtgtctctgtgtgtgtgtgttcatgttcatgtgggatgtttgtgtgtacctatgtgtctctgtatgtgtgtgtgtatgtgcatgttcatgtgggatgtatgtgtgtgtttctgtgtgtgtgtgtatgttcatgtgggatgtttgtgtgtatctatgtgtctctgtatgtgtgtgtgtatatgcatgttcatgtgggatgtatgtgtgtatctgtgtgtctctgtatgtgtgtgtatgtgtgtctgtgttggcggatagtgccacctccttttcctgttttgttggcataccaaaatgtgccaggcgagactgaaatctctgccttccttcttagatggatttaaccagcctcgacctctcctgaatgttattgtgcttataaagagagcccacgggaaaatttggcaggtgactggtgctaccttcttttactaagcagcagtaatttttaatgtaaatttcagtgtttcctgaagaggcatagatgatgctttcccagacaagcagtaggtgctgtagttccctctgtcctttagtgggactctggcagtgcaggcctgcctgccttgtgtgatgttcattatctgtacatggtaggagccaaacctttcagcagatttttctttctcaactaccttccaataatagggatttggttttgtctgtccatctataatgcataacagtttcaaataaatggcttaaatttacattttcagacaaaaaaaatcccagttttagctctatttccagaacatcagcagtgccaggcgcttctttaaaatgaaatattgtccccttggaacccagcttagaattctgatgtggataggcacagctcaaataaccctgcgtaatctaattagacctagcaaaattccaattagcaagcaagtgatgggtgagtctagtcaaactttttcattagcaatgacaaaaaaggacgtctttcaggtgaactgtctagagtcaagatattcatgtgactgtgtccattggcttgctgtattccctctcccgttattgcaaagagttgctatgggcttctgcagaagcagcattggtgagaaccagtgtgaatgtcactagcaagagggctttgagcaatgggatgttcaagaggaaagaaactagcacaagtatattggcaaatgaatgagccactgaatgggtcaatgggaaggtgtcattctcattgtgaccgtgacctgatatttagtatctgtcagacaggagtcagggctgaaaaaatgtaaagaacaaagcagcctagactatctccctgggaaaagattgctaagcatgttgcacacacaggcaaggagtgtttgtataacacattttctagctggaggaatgaaggtctaggagtgtttgggagtgagaaacacagatcctacacctccacctaggaaggaaagccaagagtttaactataggttgggatgaaaagtcaggtggccccagcagcacccaggctgaggatacacggtggagctgtaatggttaagctatgggagactaccatggaagagcccccctgtgcagggaacagctcgtttctctctggtgctcacagttttgatttgccttcctctggtctgcaaggccagatgacagtgaccttgtcagataccacaaaaataattgctctctgggatttgcatggtgctgtaggaattggaaactacagaggcttcttagaaccttccagccttggatttaacgattaaggagtggaagggaaaggggaatagtaaattgcaaagcctggacaggctctctgcttcaggccagatgtgtttgctcatgtgatttctgcctcgtgttctctcaggacctcagacctacagaatttctgggataccagggatctgaacaaggaatgactaatcaattacccatttatctgtttatctcttctcattcctcatctaagaaagggcacttaaatctcttgatctgaactcagttactcctgagattttatagccccagttcttaggagactctaacctggggtcatgcctgggccaccaaatttaaccctttgagaggaaaaccttgactgaggggcctccttgcctggagtcagtggctccacctgactaaatcttagtacaggactaagagccaagaaaactggacctatagtcctgatttgctactgacttcacaatgccaccacagagtaattatgaactaaaatcttaacatcaatgttatttaaaatattttaaaaatggaaaatacctcaaatcttatataggaaaaaaaatcttataaaggtaataagttcattaaatataaatatatataaattttatatatttataaggtatagttttactgggaaatgcgtactttatgttttgtctttttgaaaaaaaagttttcaagttgctacctaaaaaaaaaaaaacttcaaaaaataattgattaagaggctagagacctacaacctttccaccctttcctatgattgtccccatatcttgagtgtaggacttgtattgtatccattgggcacaggaaccccatgattggtggtctctgtagcttgaccccaagtggttttctgtagtgattctgtctgatgcaaagagagctttttgataagggctaagagctacacttacctgtggctataaggactggtattagagttcaggtaggaattaaacaattcctgtttttgtccttcctagctcttgatacctgccattctaatttctatgtcctcctgtgacttaacactacaagtgtgttccttgttacatgtttgtgcatgcgcattatctgtaaagaagatgtgctgtatatacttaaggagacctactgtagtgctaagctgctttctcttttccttaatgaataattttgcaatgaacatctttgctcctacagaattttttgtaacatcttgggctttattaccggaaatgagattagtttgattcataatgttgaattacttctaaaaaggttttctatcaatttgtaattccatcctcaaattataagacttgttgcagtcgtctcccaaaacaaaactcagagatgcagctagtggtatgcaacgaatatggtatttactgcattttgtgtgatatcaccttttttcttcaacctctcaaaagcatcttcacagcacatgtattgattatcgtcagcacattgtacggtatgtctcgaactgatccctctttcccaactggaattttatagccaagagctgtgtcgtaccagctgtgtctctctgagctgctcctgccccctgggaacccactgtctggtctccagttcagtgagattgactttttcaggttcagtgaaagagtgagtgagaccagacaatatttacttctcctcatctgcttgtctcatgtaacatgtcctctccgctcatccaaacaggcttttcttctcctatccctacactgtatcccattgtgcatatgtttcgtgttaaattccatccattcacgctggaacatgggtgggtcttatcttggctctctatctaagtctttggtctgttttgatttgagttttgcatgggatacaatttcttccacttcaaccaaacataattgattcaaatgactctttcctagttatattttctgttccatgattttctgttttgatattttgagcatagagcactttttacagtcaaagaaattattttttaaaaaataacctgtttgatagatctcacaggtccaggttagttgagactgctggcctttctatggggttgccctctgcctcagcttcttccagcttttccctaaatcaaccacagggtccctggcttctgtccattggttgggtgtaattatctgcatcttttagctgcttgttgggcctcttggatggcagctatgctaggctcctgtctgtaagcataccatagcatcagtaataatctcaggctttggagcttctctttgagatgaattccaacttggacctgtcactggacctcctttccctcaggctcttctccatttttgtccctgcagttcttttagacaggaacaattctaggtcagagtttttgactgtgggatagcaatctcatccctccacttgatcctctgtttttctactggaagtggcccccgagatctctcagacactgagccaccacccaggcagcatacaccagctgatatgaggcccctaacacatttacagcagaggactgcctggtctggcctcagtgagagaaaatgtacctaatcctaaccctagagagacctgaggccccagggagtgaggaggtctggtggggtgggggtgaaaggggtgggggacatccctcttggagacagggatttggggggagtttgccagtgaggatcagtcagagggcatactgggagggggataacaactgtaatataaaaatagattacaaaataataaaattacaaaaatttaactgtttgaaatactaaagattttgtcaagaaccttgcagatgctacgtatgagttctaccactgaactgtattcctaatttggaagtgatcttcgttgcgccgcttttattgttgtatcatttttagctgggaatctttgttttaaaacttgcagaaatttgatcttacttcatagtcgtgaacttcatatttcagaagttgtctgcttctttttgcctctcattttagatagatggcctagtaagtgtgcaagcttcattatttttctgtgttagaatttacattggattttaactcatcttgaatcatttttaattatgatgaaacgtgactgaagttcttcccagctgttgaccaaatatcctagaaattaatcttacactcaacttgtgattagttctttatcgaatgttaacttctatgtaaagaatatttttatataagaatatttctctgctttttacctttctgtcccctttctccctctttcccttcctctctttgtctccctctttccttccctcccctctccttcccttcctttctacttgtctccctccatcacttccttccttccttccttccttccttccttccttccttcttttttttttttgtttgtttgttttaagtccaggaatcactgtgtagcccaggctggcctggaactctctctatagaccaggctggcttcttgctcacagagacttcctgtctctgactctcaagtgctgggcttaaaggcacttgccacaattctcagatatgcttatttatttttcttattcttttgttattttttattatttgtgataaatctaacttagatggctactgtaatttcaacctaataagatttctttgtgaccaaataatgtggtcagttttggtaattgttcaatggttattaaagagtagtttactgagtaatgagtgtgaatgtgtgtgtatacatatatcccaggatgtcctcccttgacggaagcaagacaccaatgttgttatctctgtctctgttctcttggtttctcatttccttatttcattttcactttgttgtaggggtttttaactttagattactgttatttattatttatttttttaaaaactcatttcacatacagacaatcagttgcttttatgttttctcttactgcatcctatatcctatttctgcaggaattatttttcttctagtcaattctgtctacattacttggcagaagcaatttcttttgagacccgtgaggggttctgtcccttgctttcttgcatctattgcaaaaagtgtagttttacattttttttaaaagtgaattaaatgggtataagatcttcgagtaggaagagatcactatatttttcaattcgtttctcagttattcacctataatggtttcctttgttagtctggagttccagagtttctgatgtttagagccattcccactagcataagttttggtttcataggtacgtaatctagtcttgattttgttcttgttttctttgctatgacttgcctatccaatcactttttttatatttaaccataaacatgaattaataagtgctcttcatgctgctgaccatcccccccccactgaatctctgccaaatgctgaatgctctgtgctgtacgtaataacacattacaacgctgatttctttttaagtggcagctaaatagcatgttcctcaaaaattgagttcatatatacaggtagtgtgctgagtggggaaaatgttggctttattggcttttaagtgactcagccattactccgatgtaggggagttggaggggcatgtccaaataaagcatgcttctttaggcagcataaatgaatgtgtcaatatggattgacaaattgaaggtttaaaacgaaaagatactctaaaccagaggttcccaaacacggttgcatcttagaatctgaactttcaaatgtcctatgcccaaactgtacccctgactattcatttagaatatcctgagctgggtggcaaactctgtactggctttcgtcttcagcctgcagatgcagcaggatggtgcaggaactgccaatccatgggctggtacctcagtgcgatctcctgaccaacagcccagcctcagccgagagcttgttcccagcacagaacatcaggcccctcacagacccaagcagctgtagccaactaatccccgtggtctatttatatgaacggaatttcccagcaatgaaactatacatgctttacatctcattcacagcagaattgagtccttgtaaagaaactaacatgttcattgatctctgacctctgtagccatctacatactcacactgcatcacacacacacacacacacacagagagagagagagagagagagagagagagagagagagagagatctgaataggctttttctaccaaccccacccccagccccatgatgttcaactggctcattacaggcctaaagccaggtggccagacctcagaaacggagacaaaatatgagttttctttatagcattgatggtttctatgatgttttgccacaacagtagaaaaaatggcacagcttctgtcagcccagtttggacctggaatggtctgatggtgatctggttcagagaagtgaccacaagtttggggtctgggtactctccactccagaaacacttctttgagaagccaagtgttcccccctcttttccatagacacttggtttttcacagtcttctgggtagttcccattaggaagacactcagggctaactaagcaggcttccctaacaagattataggttgtccttgtttgctttctgttgttgtcataaacactgtgatcaaaagccatttataaaggaaagtttctacattttatagtccattatccagggaagccaaggcaggaactcaaaggagctttaagcagtaaccatggaggaatgctgcttactggcttactcctcgctggtttgcccagcttgctttcttatatagcccaaacatacctgcctagggatggtacggcccatattggattggtcctttctacatcaattaacaattagcagaatgcctcacaaaatgcccacagtccagtctgatctgggcatttcttcagctgatctctctcttctcagatgactctaggtttgtgtcaagctgacagttaaagctaatcatgacctagatagactctatgccccctccattccttatattcctagcttcttggaagtcattaattagtatgtggcaatctgcaaacaccagtatttaagaagaagaagtttaggacagtggtactctatcattggtttgaagatatatatatatatatatatatatatatatatatatgtgtgtgtgtgtgtgtgtgtgtgtgtgtgtgtgtgtgtgtgtgtgtgtatgtatccaactgtgcacacaagcacacaaagaggagcatgtgtagctaaagcaggaacagctgccatgttgctagtgggtctatcccatatgactacttcaagttcagtacctctcactttatgacatggtgttgtaagatcactgggtggcctgaaatgtgaaactgtattctccaaccttctatgtatgatctgatttaatgtcttgattgattgattgattgactgactgactgaatggttcgagcaacttgagaaatcaaagatgggctattcaaaaatgttttagttgctgattttagtcttgtagagttacttgagtagttgtcaaaaaatgtttgttaaaaaattcagagttttgctcaagtgttatcagtgtgttagcttttcatctgagataaacaaccaagacgtaggaaagttggatttggggttgcaatttcggaggcttcagtcatggtcactggctgttccttcggactcagtgccactgtggagagtgtttgctagaatggagctcttcatctggaggaggctgggaagtgaggaagagaagaggaggctggggttccaacatcttttttcagaacattccctgtaaagcacatttcccgctgatgccacagccagagactgagcctttcagatgtgagcttcaggggaactcgtaatacttaaatgagagcatctaacacttccctgtttaatatcctcccctagttctgatgcttatattcagtgtttaacttagtattatacttggaacgtggaaaaaaaaacccaaacaaacagacagatatattttgctcttttaatttcataccatttttcttttcatttctagagagttcttttctactgtgttatggctgttgcttttgaccccggagttgtctgtacttccttttactcctcctgtgatctccacgccattacctgcatttacctgcattgtgtgtgccccccccaccccccccacctcaggccctgattctttgttgttgctgtagaaacaatttaatcccaatatagaatttctacccctacctttgatcattcagttcctggataaaagatacaaatcatctttatatttataataagcctttatcagcattaatgttgggtatatatctatcccctatgctattaatctatttcccatcaataacctcaagttattatttactatgcttcatttgggctgctcttaactccaattggccatccctcggggccatagtgtcctgactcctaaccatttttctcctctttccaccttcttctctcctgccttgtggtctaccataactccaagactgagaatactaagccttgcctaattctgcccagctataggctttattcggcaatcagaaataacttggggcaagatcacatagcctctcttgggtctacaagcagaaaaggactctgccatctttggggcaaccaggtcttgggggccgcacacagcattacagtacatagcaccagatcaaacctcaacattgttttcactgttttgaggcaatgtctgttcagatttggattctggccgtgttggacagccttccagcagtctgataaggttgtgttctcagcttccaaacctctttcctttcacctaccttgattctcatgcctgcctgttgcagttaacaatatatatatatatattctttagcaaagtaggaatatgccttctgaaaatcaccttttcttcacaaggatggattcttttctgatgagcaatgctgcctttgagccaatatcactctctccctctttctttgtaagtccagcacttccatctctgaactgtagcttagttttgacttgttagcaagacaattctacactgggccagttttgttcaaggcacccagcacccaggcttcattgtggaggagcagtgtgagctcgccagtgacactcgtggcttgcttcatctcaccgcgcacattaaacttccttcacggtctccttaaggcgaacagactaacttctcaccccgtgcacatagctgccagctcagtccactatgctgggccacgcctagcccttgaggtgcttttgaacgcccaggagaggaaatgccctgggaatgggctccccaagcctgcggatgtcatttggcgagcagggctccagggcagtggtgaagatcttaagatccacggcctattgggatcatttttgtcacatgacttagacagaaagagagtgacccttaaagaaagaaaaggagtgacaaaggaagaagctggctgtggcagagcatctctgccacttggggggtggaggatggagaactaggagtttactatagactgatttttgtttatttatgtgttttgtttgtttgtagtctgcctggctacctgacaccctgtttctgagaaacaaaacaaagcatctaaaacgattcattgattgctgtctctctccactcagaagctgtaactcttccatgcaagagaggctgtggatgaaaaacataattggcattagtgaaaatgcaactattaaaatgttgaatcccaaagttgtgaagtgtgatatcttattgacctgtgcttttttttttcctttctcttttatcttgcttttaactgggagaaaatttaaaatattgtagaacacaggtaactctctgggctatagtctttattttatcagggctgaaaataaagattaaaaaaaaaaatctcaaagtcataaggtgatccgatttattcttaatctgctcttaagcacaagggttaccctgagtgatccaagttcccagtataattcagagacctaaattctgccacactactgggtagctcaggaaaagggctttacatcagaggagacgatccttccctaatgagggctccctcctccagcttgtccccttatgtggtttcaaacagctcatatttaactggaaagcccattcactatctaagattaaacaagtgaagaatccaaatgaagaggcaggtccaaggtactggagcacttatcttctgcaaggcctacacactgtctgagcagacacgagtggcctaactcaggcagccactggctgtgagcaggacacccaaaccttagaagtaacatgtctgtttcatttttctttccaggcttgagatttttaagagctctcagactgatacagttttcagagattttgcagtttctgaatatccttaaaacaaggtaagctactcattcttgtctggttcctttggatggggttgtaaataccaagtgtatgtttccattgtgctaaaacgatagagttacattactcacaggaagagctggagagctcacctaccaaggtaaggcttgcagcgttctcctctgcagggtcagggagaaataggagagaggcagagacatggttatacatgtggggaagaggagacagtccaacaaggtcacatagatggcatcgaggcaccaaagcagtctgcaacataggcatcctgggagaggcccatccatggtggatgagggatggactcgctcactgactgggaagtccttgttgccaggtcctcaacaccccttcagttaccactaaataagaaattgaacttggctataaaggcaagaggagcaacaatgttctttgacaggcattcacaaagctcatatggcaaacagaaaatcatctcattcccaagtccaatgagctgtctcactttatagccatagagctctgaggtgtgctctgtaaatttgccttgtgggggaaaccctaaaagcctcctgtcaaatgcaccacgactgcttctgttaactgcattatgatctggaaaacatagctaggacagggccagaaattccctagggggtcccctacctgatgacctgttggcgcccacagctggcctgaaacctggcctgtgctggtgagcacactaataaaagggtcaggagtgctctaatggggagcgactgcagctcataaacttctctactaggaaattacattttaagaagaccccttctaatgttccatttcctcttccgttggccttaatgtgtctgatgagtgacagaaagcaggacacctctgtgtcgtgccgggtataattaatgtacctgctgctcgagggcttggattctgttggtttcctacgcgtgaaaacctagcttcttgcatccagtatatctggcaagtgtgcttttattttgttattgatccttattttaattctatattatcctcctttccaaggattcatttgtatcaataagagataaaattcactttctattgacagtgcaaaatgtacaaagagccacgaagctctcttaagttatgccttatccctttatattttatcttcagaggtaaaaatttattgttcctctatttttgatttataatattattcataataattttttaaatgtacagtaattcttagatgttctttgagtagtagccttaagttttaccctttaatagatctgtgcagtaggattatattacttttgaaatagaagtgattaacaaagctagtgtatctaactaggtcctttaaccccagaactagagagggagaggcatacagatccctgtgagtttgaggctacctgtctctacataataatttcctgactagtcaggcccacagagggagaccttgtatcaaacaaacaacaagaaaagcatatctagtatgaacgtctaccgagcttgcattacaaggctgatcaggcccccccatccccactctcagggagagttggtgggtatatagtaccaaacttggggcctgtcctatagatttctgttctagcagggattaggatagaggtgctataatggaaccatacacatgctctcacataccctcaggtctctttcttctgtttgtcattgacctcataaatcaatgagacttgttctatgacactgggactctaggaagatcctagccatactgcaggaagaatagtgttcgggccctccgcttcccatgcagatcccctctgagtgaccacgatatgccatctgagtatcttttaccagccttgtgttaggacactcacctatttcctgcccctcagcaaagatggcctttcttttagatttagaagttgggtatggctctcttggagaacaggttcttcatagctatgtacgtatgatgctgcttaattgtttaagcaaaggaggacgacagtagaaatttctggctggaggaagagggattgtgcttctgggggcagcagctctcttgcacagtagcagcaattgagtaactccaatcctagcccccaaacagcattttctcaggactgtcactttccacacagaaacttctactctcagacaatgtctttcctcagactgtgcatgtccctggttcctattattttcagttagaaccaggtgaccatgtgaaccctgtgaatctaaggtgagcatctatgaatgcacaagtgaatatggagggtgagcgtcccaacaaatattgtagctagaaagctggaggtctcatgggatgggaaatcaaaaccagacctcctgccagagtacaggtgttagaacaggagtgagcccaggtctgagattcagagttgttgtgctgaacctggcaggagctgtgcagcagggaaggtctttccctaggagaagaaagaacccttgagaaaaatcaagtgtctgacattcagtgggactgtaggatggtcacatgaagggtagggaagatgctctgagttctgtcaaaatatttgtagaaagcacacagtgagagagaatgtgacacctgtgggacctttgagccattccgtgctcctgaacatgtggttgacataagaagagtgagtttagggtagggaggtaggaaccaaatctctaggtaagaaacacttccttcagctgcaggaactctagcagtgtggggacactttctccttggggtaccaggctacaccctgcttcttcttcagacactccaagatagattgtttctcagctctctggaagaaatgaagccgcaggtttctagggtttagccttgggcagattctcttgtgagccctgtacacttggatgctttcatggtgactttgtgaggtggggaactgtgtcattgttgttaggaaaatcctgcctggctttctcttgtaataatcccctgccagtctgaggagggagactctacaaatatgataaaaaataatggtttgaaaaccacggttttattttgtattcttccattgcttagttcatcttagaactgaaagaaatggaacacagcagtcagtgtgttggtgggtggggggaggtaattaagaggacaacagaaggaaccagagtgacagagtgagcaggaggacaggcacgggattgtgtagccagaatcagggcaagtccccgacttgtaggttagcagggggctgagattctccgtctcctgacttggcctatttaaggaagaccagagattctgggtcatctatgtgagcttctggaagtccctcagccatcctacaagctggtgagtcaacttccagtgctgggtcatttgttccacaatgaaatccagatgaaatctgcttatgggctttaatcccacatctcattcaacatagtcaataatgtttattaaaccatggattgcccgtacattcgttttctaagatgaaaatggcctcatggtttcctctaattgtttaagtaacacgtgcttcctgcgaacatttgtaccatatgtaagagtgtggtgtgtaaagggtaaagtaagacaccgtgcctgccctgtgctgtgctgtgctcagaaagccattgctctctactgtgaaaatgttctttcctatgtagcctatgtgcacagctgctaaccagttacccaaacaacacatgcagggaacatttttgaaattacctttattacatatatagccttagaaatggccccaaggctgtttgtgaagcaggatatttgctccagagattacagggggtacaaggtagaagcctgactgtgatggctgcaagatggagatgttgaaggcttttaattgggggaggaaatatagacatagcattctgaaagtccatgtttcctctagttgtatagaattggtttgaggtatctaagatttaataggtcttaaggccagaaaagaacagtagtagcgaagggcttttgaggccaagcctcagagcaggtcaggtggacaaggaagagaccaatacagagataactaaagaacagactatagagataacttaggggcaggcatgacacaacttgattttgattcattttgtatcacaaagttcattaatctcagtgtgacctggtccgtactcacgaccggccaggaagaacacaacaaaccagaatcttctgcggcaaaactttattgcttacatcttcaggagccaggagcacaagccccaagccccaaaaacgaaagccccccgcttacatctttaggagccagagcgccagagcgtcagagcgccagagcgcagagcaagagagagaatggcggaaaccccatccccttttaaggagaattattctttgcctaggacgcatcactccctgattggctgcagcccatggccgagttgacgtcacgggaaaggcagagtacatgcagtggtaaaatacccttggcacatgcgcagattatttgtttaccacttagaacacaggatgtcagcgccatcttgtgacggcgaatgtgggggcggctcccaacatctccccctttccttttaataagagcaataggccacccatattaatgagagtggagatagaggtcaaatccccagtgtgcaggtaaaggagccatgtacaggattagctcttaggctcacaggcttttacccagagcaaccctgaccggctcccgtgtcattttgtctggagagaaggacacttggacactcaaccttcttgaaagatgacatgtctccctagaataggctcatatatgccgcagagcccttctactgcagtgcttagccgtgcaactctctcgggctgctgaagcacactcactctatcccgtgcaatgagtctagcctcgtggtgtataagagctgagtggccagcaacctattgcttaagcatagatatatcaggggaagcaccatgttctagagctgcaagtgcctgggcaataaccaccttgtctctcctagtttgggccttaagcttacagaccaaccaaagaagcaacactaatccacagcaaagtgtatctccaaataatatcaatcccacccattctttaaagaaggaaaatgctgaggagatccaattgggtaatcctttggtcagggacaggtccaagcgcgtggagttgacctgaagtctcaattcccgaaggatctgttcaaattcagccgtccaattctgtaacatatactgaaaaagactttttgacaaattagctgccctagtaaatttctcatactgaatggaagtaacacacaatcccggaaacttttgttcacatcccagctgagctatttgccataatacatctagttgtttctggacaagatctatgagttgattaaccagcatgagaccaccctgtatcttgacattagctgaggcctgtttaactatgactgtagtcactgaggctgacaaagtgttaatggtgtcagtcgtctggacctgtccagacagagccaaggctgtctgaatcaaggccaaacccagttcctagttagtggtaaaaaagcaggggaatacttgagcattatacatcaccgtcattaggagtggaaatgtcgacattannnnnnnnnnnnnnnnnnnntcagtattcccttggtcagtctggatttttcgggtgagtctttctggtatccaaaatgggttgtcttcattctgtgggaaaacacagatagctcccctggatcttatcaaaataggatccgggccataccatttattatcaaggacatttttccatttaaccatctcattgggcctatctggctctgaacaatgacgttcagccgcagtatggccatgaacatcaatatttaaaaaattgagtgtaaagagtgccatagacacagacactcttggtactcggggtagagtctcctcaattcccctcttctgttttataagataggatttgagggtgcgatgcgcacgctcaacaataccctgtccttgagggttgtatggaagtccagtcaggtgggtcacgtccatctgacggcagaactgctggaatttttgagatgtataagctggtccattatcagtcttaaggagtttgggtttcccccaagcactccatgcctcaagacaatgttgaatcacatgtgaggctttttctcctgttaaaggtgtggcaaacattacaccagagcaggtgtcaatagaaacatgtaaatattgatttctcccaaaggaggaaatatgcgtgacatccatttgccagacctgtaatggcctgatgccacgagggtttacccctacatgaggagtagataaaatttgacaacaatctaaaggcattattaagtaatcagaatcactttcagtagaaccaatccctctggcagctctaggaataccagaggaaggaaaaacagccatgtaggcttggcaaaattattagttgagctattctgtccctttgtgatatagaaaagacaacttgaggacaagaacagagaacctgaagttcccctttacaatcctgatctacaactccagggtggacaataagaccttgtaggctgcaagagcctgcctctgtcatactggccacaaaatctgagaaggactcctgaggtccctggacgatctttgttaattgtccagtggcttcacctgctcgggagagcgccttccaggccctaatagccttttcatctgattcagaactattaaaaactggctccttgaactcacctagtgatgagtataggctccttctcctagaaacctccgctgattgatcttttttcttttctttttccttctccttccttccaatctctccccaggtattcttacctgacctaaacttttcctcgggttcaagacccttggaaaggcctgtatacttattttgtgtaccatattttctctttgctcctactctctctccccgctttacttctgatagattgtcctgaatttcatctagaattttcagccctgccttaaccacttgataacatgtgaaaaggaacaaaagggctcctaacactagagaaagttcaaggccaaacataccttgtaaagctattttccactttacttctgatagactgtcttgaatttcgttagaaagttcaaggccaggcataccttgtaaagctattccccactttacttctgatagactgtcttgactttccttagaaagttcaagaccagacttaccttgtaaagctgtactcactggtactcctgttccccagctgaaaagttctgaattcacgcagttgaatccttctcaacagtctgtgatgcgggaacactttattaccgccgtttcccagctgaagagttctgaattcacgcagttgaatccttctcaacagtctgttttacgggaaccttcgttaccatgacccgcagttctggttccgtaatgagggatcttccttgcgccggtgatggttaactcccgtcccgagttttcttgtattttctcgtcccgggtttcttcttcccggcttttctcgtcccggattttctcgtcccggattttctcgtcccgggttctcgtcccggattttctcgtcccggatttcggcaccaactcttaaacgcgttctcacgaccggccaggaagaacacaacaaaccagaatcttctgcggcaaaactttattgcttacatcttcaggagccaggagcgcaagccccaagccccaaaaacgaaagccccccgcttacatctttaggagccagagcgccagagcgtcagagcgccagagcgcagagcaagagagagaatggcggaaaccccatccccttttaaggagaattattctttgcctaggacgcatcactccctgattggctgcagcccatggccgagttgacgtcacgggaaaggcagagtacatgcagtggtaaaatacccttggcacatgcgcagattatttgtttaccacttagaacacaggatgtcagcgccatcttgtgacggcgaatgtgggggcggctcccaacagattttgattcattttgtatcacaaagttcattaatctcagtgtgacctggtccagtcaatgctttaaattgggacacttcttagctacctagcaaatgttgcaaggaaaagataaaaatggctgttggctcctggctgtgccctcaaccagaagcaaggtagcagtcagcaagagggcagaatttgtgctttcttgtgcaaagtggctggcattttcaaggttcaccaggacatgttctattttctgtaagggcagagatgaacccttggcagctttggctttactgatataattttcgaaatcagactctctcccagcacctaggggtcctgggaaaggtcactgatcagtcagactatcgcttgcctattgatgaatcactctgtccacccatatcaatgactggagttcagtgttagtcagactgtgccaaaattcctgagaaaacaacataagcaaggaaaattatttgagctcagagtttcagaggtttctgacccatggttggctagccttgttgctcctgcctggtggcaaagtggagtgtcctgagaaagcaaagttggtcacctcatagctacctagagagagggaaaataagtagaaaatgggagaagacatcagagacaagatgtagccaccaggaatacatggcttctaatatttctaacctacttcctccatctaagccccatttcctaaagttttcagactctcccaaaatagtatcaccaggtgaggaacaagtcctcttaacctatgagcccttgggaaacatgtcctcctgtggtggtttgaataagaatggattctagaggctcatgtatttgaatacttgtttctagtttggtagaactgtttgggagggattgagaggtggggccttgttgaaggaggtgtgttactttgaagtgtcaaaggccacaccagtcccttccccttgcctagtgataaggatggatcctcccagcttttgctctagggccatacctgcatatctgctgccatgctcccagacataatggctatggacttgccccaataaatgctttttttctatcaattgctttagtcctggtatcttatgatagcaacagaaaagtaactaagacatataccaaaccagaacagccacggagaattcatgtatgggaattcacaagtttccataaaaacacagaaatgacacttacaaaaagagggggcaggttttcatgatcggatcacaatctctccttcaaagcaaggagctagactctgcatggtcagtgccactctaactactgataatttcatgtttgattcaagcctttgggcttggccaggaaggctgcagatagccatctccaatgactctttttgccacaaatactcaatgtcttctgctggcaacccctccctcctttgaagcagtcatcttccagatgtcaaagtccacatcccagcggacagagaacacccatcattggggttaatcttgcaggttttctacatagctttcagatattaacttggtcatagggttcagcttggaagtccacttcctcgtgcgaacaatctgtgatgttgctgatgtcatacaattaatcagatttccacaacaaacctggtctgtctcagcagtggtgattaaatgttctgcactcagcaagagctcccttaagcaccattaatgtcccagtgacaatcatttagagattaataatcaccatatttaggccatttccccaaagcaccaagagacgtcagtagatttaatatcttgaaaagactctgcatggtttttgatggtgcagtgctttcgcaggccctgaggatctgggagtctgtaagtgactcaattaggtgttgaattctcccctggaaatagagagcagcacatgcctctcctctctctgccataggctacctgctctccctactacttgcttctcttcaatatcagatcacgtcttagggggctcgaaagggagagacaggggaatgggctgctctgctttgattttccattgagaaatttgcctggagcaaggtttagtggtaacatagctgatgagacagggtaagcctcaaacttctgttttttcagttggcaattccattctctgtcagagaacttcgcttgatatgaggtgaagcacagagtgactcattgagatgtctggaaaaggcttgaaggtcaggagttagcacaagcagccttgtgcttgggagtgctagcttcataccacagcatccagagccctggagctaaccgtatcaggtcacaaagtgggcggatatggccaattcgtatgttctctgagaacattctagatgtgagccatttcaattgtgtctaggcaagtggcagagtgactgggtcccagagggagtgacagacttttggcatatctgcactcaggctgtcagcttccctccttaagattctgctcctctcttcatctcttttgggtttgttctctggaggtcttctcaaggattgtatctgagatggattagaactctcttccacaaagttcctgaaaactctggcaggcttctctgttggctgatgttgatgttggctgaattccactggattatttagtaaaggaagtccttggtggacaccttggtctcccatgtcagtagctgtggggagattggtcgttaggaagtgatgatgggcaaactacagggtaagggaaaagaggatccctgaggcttcctatagtgtgttcccaagctacttagatgaggcctgccacttgtagctgtgattcccaggcaagctatctacaccccctaatgctcggtttcctcaatagtgagtgacagtggtgttctcacctaccacctgcattagcagaaagagtgaagagggggaggacgcaagcaaatacttagtacatcaaaaagccccagcagtcctcagggaccacaaatggtgggtgatcctggcgaggaccaagatgcccaggatggacagtctgctgttttgctggcatatggtttccaaccccgaggatgtcatcccacacacctcaaaaggctagtttcacccacaactttggaagtgtttactcattcttgtcctgaactgtcagaatcaatgccaggcaaaccgggaacttggattcctctcttcagttatataaatacaagcagagaaagctccattcctcatgctccacccaggaaacatgatcgcagcctttgttaggaggcctcccttacgaattccccaggctgagcaacaacagcctccatcctgcccttttagcggtatgctcaggatccaaaagctagcagccatcaatgccactgacatgacactgtggctgtgcagtaatagatctgaaagtggctgaaatggccacatttccatctccaactgtggggcctactgaactaaacttgtcagtttcccagttcccccagatgatcttgaaggatcctatgagaaattagtcagtatacatcaaacatcagcatgatggtgtgtgggtgcactgcgtacatactgtgaaagtctcagatgtcaccattgttaaccttctaagccattagaaagtagataatatattacccaagagaaagaaataggcagaaagagggcagtgttaccatagatggattacccaaagagaaggattagcttctgcgggggttgtgtcttagggtttctgttgctgtgaagagatattctgacggcagtaacccttatagaggaaaacatttaattggggctgccttaaagttcagacgttcagtccattatcatcatggtgggaagcatggcagcctgcgggcagatgtggtgctggtgaatgggctgagagttgtacgtcttgatccacaggcagtagaagtgactgtgtaccacactgggcatagctggagcatatgagatctcaaagctcacccctacagcggcacactttctccaacaaaaccacacccacttcaacaaggccacacctcctaatagtgcttcctctgggccaagcattcaaacacatgaatgtatgggggccatacctattcaaagcaccacaggctgcatagggccgggaatgggagaacaggaggtgggagacagagttcttttctgcaagatgaacgtgatggaaacaccattaaatataacttcaggacaactggcatttaaattgggattgtatgctagatcgcattgctgaattcagttcgttttctgatatacagatgtgtccagattctactgcatggtgtctgctcttcggagcagaatgccgcggtgattagaggttgggcggtgatgtccacaacacaatggctcaaacaaaacaaatacaaccagaaagaattatcacactgaagaaaataagacatacttgcagagatgatgaagtcatggggaaatgtcaatttaggtgaaggatacacaaattttatttactcttctctctggtttctttttaatatatatttgaagggttttgttttagacaagttaagttttagcaacgtttgaggggttaatgtagggtctggctgtgattttcctacagactctgttgagagcctcattcctgaccaatgtttctcccctgagtcaaatttccttatgatgacagcagcctgcttctgccccagaagggagactgtgacaccatcgggcagttccatacgggtcttctctctgtaactttgggactcttcttgtctcctttgtacagtaactccatcaagctggtgaatctgctctccatatttatcagcacgtggctgactgcagctggattcatccacttggtaagtagctggcatggagcaggcccttgctaggccgttttattacttaacatttgttttcttggaaagagacaagtttagctgtacatacaggaaagtgggacaagctactcaattttcagaattccctacccttaacttccacccctcaaactggttccaaatagtgagtaatgttcctaggaccaaccgacatctttcagcttcacctgtattgcttcagggagacttgcctagtttttcactctgtatgcaataacctcagaaggccacaagatggcagtgcttccacagcaaacgcccaggaaaagtctggcacctatactgaaagtttgaacttcaacagctctttgtaaacaacaaatgcaaatcctgggatctgtccctacttctctcgcacaaaaaagctgcttttgactgtcttgctagatgacttctcaagtcgtttcaaaacccccaaatggttttgtttttgtttttttgtttttaaaaactaatgactctttgaatgctattaccaagtcaaacctttcctacctccccaaggcagagttctctagcctgctttcagagagaatagttactatgaaatgtacatttcatctgcacataaactgttacaatcagaagaagcccccaccagactataaaacttagcataagtgactttgtttccatctgctaaacaagataattgtggattttgcaagagtcctatacatattttaattatgtgtatgcctgtgttttactgtagggatatgtgcacatgtgtggatgtacccctggagggaagcagagggctttaggctctctagaagtgaatgctggaaattgaattccagtccttctgcaagaacaatggttcctaaccattgagccacgtctccagtccctgtgtaactagtcaaccttcaccttttatcattcagttccttctgaagccaattgccagttctgggctcaggttccccaaatcctgctgtagcccccactctttgctccctgctgggcttcagccaagctcacagaactgagcatctgcgcagacctcaggaactctgcagcacaagcagaaactattggctcaagggccattttgaagacgtctgcagccatttctctgatggtgtgtgtgtgtgtgtgtgtgtgtgtgtgtgtgtgtgtgcatgtgtctgcagtttccaagaggtcacttctcttgtttcggaggaaatttccaaacctcggagctcagaattgctggtgggctctggtgaagaaagacaagcagtcccagaagcagagatgatgctttggattcaggctgtagatgtgtcccaaagatgttgggtctggtgttcttagttacacgaatgaaaggaaagtctagagtctcagcaggaatccccaagggactggcagaaggaagcatctagcacctgccttaaagagatgctgtaaagtgtatcaagcatcagcgatgcgtaggaaagcacaccagcgctgctcctcctcatccctgtcctgataccccctggggtttctggtgaatcatgccttagtgactagcaatgagaatcatctattctgtactgcgaatatgaagcgtatgtaaaaaacaactttcaggagctctgggcatcctggtttgcatatactgtacatatgaacatctgatggctttcttttctctccctcccccctcccttgctgtaggtggagaattcaggggacccatgggaaaatttccaaaacaaccaggcacttacgtactgggaatgtgtctacttactcatggtcacaatgtctacagtgggttatggggacgtttatgcaaaaaccacacttggacgcctcttcatggtcttcttcatcctcgggggactggtaaaaaaaagccctctttcttattgtatctattttaatgattattaatattttccaatgcccacttccttagacatagtatttttaatgtgttttgcactggaagcaagtaactgccttaatgcaaccaggagagctaaatccaaataccatagtgtctttgttgcatatttctttagtgttatgcttatcccttagaaccagacatattgtcctcactggggacagccatgtcactaggagcaaacctaatcgttttaagggaggcatgccattaataaatgagagtgtcctttagtaatggaattcactatcagatattgtagctgctgttgattctggtagatgctgtccagactctgtagatagatggcggtttcaagagctcccctccccttaatgttcctccccaaacttccaacaaacactgtggctggcacctgcccctaaagagcagggtcccttcacttaggaaatgtcattatagtcaggacataactgtgtctaaagcccgctccatttctctccttggaacaagtttcactggttcctatgtagcaagaaatcactgcattcaatgtaattccagggaacagttgcttcattttctctttcaaagtagcttatagcgaagtctgattttttttttttctgtgtatgaggtaagtgactgagattctagtccacacacagctgtggcgcatgtgcactgcacacacatttatatgaagtgatgcatacatttctctctgttttgtatgcataggacatatacattttgaaaaatgtatataaatgtgtgtgtgggtggacattagcagcatccctgcagggtcccgtagttcaggagaccccattatccagccacagaacagactttgttgggtaaaacatggcagctccgtgtctccttgctatccatcctttcctcttgtgtgatttccaaagttgacctcttatgctttttagtcatttttaaatgaaaatgtttatttttaaatcttctttttagtgtttagtatctttagctactcataaaaaattctcctttgagtgttatgtggaaggactttttgacagaaatgtatacatgtgtgtgtaagtgtgcatgcgtgtacatgcatgtgtacctgtgtacacatatgtgtatgtatgtgcacatacgtgtgtgtccatgcatgtgtgtatccatgagtgcctgtcatgaatgtgtgtgtgtgtgtgtgtgtgtgtgtgaatacttggcatcattctacaagatgtcagctcatttacgcttgtctcctttatatttttcttgactgtggtttattgttttctactgtctaggtcaactcacgtatgtttcattctgtgtggtttcaggagctttcccctttgttctgttattgttgtataatccaacacatgaatccgcacctttgcaggtctaatccttttgtgttttcagatcttagtatcccccttctgaaaaggtcaccctttctttggcctgtctttttagtctctctctgtctcccctcttctcctcaggccatgtttgccagctacgtccctgaaatcatagagttaataggaaaccgcaagaaatacgggggctcctatagcgcggttagtggaagaaagtaagtatgccaagaggtttttgtggcctccgcggcgtaggggcctctctgcatgccatttctgtttggctcttgtttctttgtctcatgcatgtaggcaatgtttgcccgctacgtgcccgaaattgctgctctcatcctgaatcggaataaattcggcgggacttttaacaaacatggaggcagaaagtaagtcagctgcacctgaggacatgtgcttgagtgacttggaaagtccctggagcagtggcattgaatcaagcccttctcgctatccccccttcctgctttttttaatgagggagggtgtgcattctgcagaagactggtttcagagcatgggaggtgattggaccatcttgaggtcttgtgaccatttacagtgtccaagagataacagtaaatatattcaaaggtgtccatgtgcacctggaaccatatcttctgctctcataccttatcatattcaccaagctcatttcacgagctggtgatatgatcaaattctggtctctgcaactgaggtctcatgacttcctggtaggtctggcatgcacactaatgggctagaactcttttcccactgtcctttgtgtcaggcacaggccaaggcctggcccatcctccctactgaaaatgccagtggctgccaggagaccttgctgataaagggtttcattacacagtggaaatgcctcctgggcaggaagtattgcagttagggtgtcagggtgccacaggcaattagagatatggatttttgttttatttctcaaatgtgaaggttttcctcttgggaactattcaagtttctgctcaggtaactttttcagcatcagtatcatcagtaccaatatcatcagcaccagtatcagagcgtgagtccagcagggaccagaagtcttattctgatgttcatgctggaaccttggtcttctgatcctctagtagggccatctcagtggaggagctaaggcagaaggatgggatggttgcaactgtcttcaaaggtcactaagaacttgctctgaaagctcttgggggccaatccgctttgttcttaattcagggtatgatgtgcatagaataaaatggtcaagcacgctgtatacccctaggaggatgtgcactgatagacataccagggaccgacatctgcatctctattaaaatgcagaaaatgggccctttcatgccagtcccctgtcccctatcatggaactgttttattttcttacttattctaactgactgtcaaattattaccttagtttggtgtttaagaaaactagagcctggcttgtagggccttctcccatggctgcctctctgtcatgacagttggccctgctggatgaagcccagggagcctcactctgattattgagtccaacacatcctgagctcaggtgtccagtcctctgtttagaaaatgaggaggtggagaaagggctcatttccttgaactacccacaggacagcagtttcctttcatagacacaaaggacagtgggaaaagaggccagttggcaccttctcagtaaggcggcatgtctttccatctccccctgtaggcctttccccttcctattatcttaacaaccctggattaggttagaaccaagctgttctgatgtctgggccatccattggttccaaaaggccaaataagcccaaagattttcctccgtcatttatctcaagccaagaggaaaacagcttcctaattcagtgtgcctttaagatatgggcatcccgagagtcccaggccctcattatagctgtctcagcccattggtctcagccagcatctccttatccctgtcccccaatgaagtcaataaaatcaattgctttgaaatctaagttgaaagtatttcttgactctaatttccaggtgggatttttttttttttttttttttttttttttttttttttttacagagtagtgtttgtggcccaatatgggtgggctgttggctgacagattttgttgatgggtggcccaaaatgaggatctaagacaagcacttgctggtctgccctggtctgatctggtcaggtttaaagtctggcatgtccacccaaagccccacctgctgaggacttcagatcatgggccctcctccagatttgttctggctctgaaatctgttatcaccacttttagattttgaaatcttctctctgtctctctgtctctctgtctctgtctctctgtctctgtctctctctctccttctctcaactctgcctctcttcttctctctccctctctccctctccccctccttctctctccctctctcctcttcctccctccctctctctctgctccactctcctttgtgaaagtgcattttgcttttaatgttctcttttggatctctaaagtccccagaccctgcgggatgtagtgtacgtcctgtcatcaacaccaggactgtgctcattactttatacattgtttcctggttcaaaagctaattaccaagtagtttaaagaagcccttggtcacttagatctttcatcagaaaatataagcttgggaaaggagtggtaataaagagccattagcaccctttgtttgatgttggttctccagtcagtagaacaagattgatgaaatgttatgtttggccaaaatttgagttttcatttggaattcagtgttgagagaatgggctgtcagaatcaataagtttcctttcgcttgggatatgggcatgtggtagtaattagcaatataaggtctttacttgagcaacgaagcatggattctggcagcaaacataatgagaaactacagttgttctattccgaacgtcaaaaagtttccagataaaattaaatgcatttgcaaaagggaaggggcttaactttgttgagagctggagttgagactcttaaaatagcaggcagtacttggagttttggtgcatgcaaaaaaaatgcatgtactgtcctcatccacacatgtatacacactccccgccaggactgaattcagcaaatacctagaaaacaacttaaacatatacatagttgagagattttttttggtatgtgcatattttactcagcagtaactacacataacaatatattaatttgtcagacaaccaaatgtaacgtatgatacaccaactgcagagacacaaaaatgtgaagtccgaagatcattcaggatggaaaaccagtgtaacagagcaatgtaaggcttgaaagacacaccagccacatgcgggtgttggagaatatggaggtcctcttggtgcttcctcgtaacttttaatcagtgtgtttagcacaacaaaaccatttcctgtggcatttccaaatcttcctccctgtccacagaagtcaaggccttcttcacccttttcattgtgtcctctatcccagcagtaggagcgggtacccatacatataccggctgctgtgtcacatatctggacaactaagaatagagaccaaagtgttatttatttatttttttccagagctgaggaccgaacccagggccttgagcttgctaggcaagcactctaccactgagctaaatctccaacccctgagaccgatgtgttaacaaagagttcagttagagaccaagaaacttatcaatggataatttggaaatattgtgggcaattagccccttgtgctgagaccctaaatcttattcagcatagtagctctcctagagcccagctggcctcccaaggcctttgactctgcctccttccttcgtgtacaatgaaaactgctcagaggtggtggaggcatgggggagacggagactcccatggccttggggttcttggtttgctgtcttttccttccacagcctcttacggtttccccagaggtttcttctctgagtgtaattcattctactcctggttagtttatgagaactgacaagatcatggtccaaggtcagatggccaagggccatggaaaataattggccacagagaggaatccatcagctgtaaccccctggatagagacagcacagctggggagccatccaggccttatgtttcccatgatgtggcttcaatggccccaaactgaggtagttctggcccaggtgtttgggacagagagaagagtgtgggtgtagagggctccacagatttttggtagccagaagctgagaggacacatggaaagaaaggaattaaaaaaaaaaaaaagacaaggagtggacaaaggagaacaggaaaccagatgtaattagcatggaaggaaaatctccatggtgacttcccaattctagagtggggagcagtttctacagccagacccatatcttgctccagagcaattgctcttgctcttgagcttcagtgttggtctcttactacaaacaccatactgttttatctagtagaccagtttcaggatttgtaggttggtccattttgagctcttgatttccaagagatagaagtaaacttatttaaagaactccatgtatacctgggaccatattttctaccctcatctggacccaatgcttcaagaattcagagaataactatatctccttcataatctccagcttgccagggcattcctctctgctagctaatcatggggctctatgcatctccttctgatttcttatgagtggggcctagtttagctacttattcaatataggctgttcttctcattcatgttcatgctccctctccctctccctctccnnnnnnnnnnnnnnnnnnnnnccccctccctctccctctccccctccctcctccttactcagaccccatgtgtttctttatgcctacttactaccttggctctacatgggctgttcctctatcttctccctactttcaggttttacccacagtgattccaggccatttttaaaggccataatatggctatttccttaaaaagattctttttatttgccccctcttgggggtctatccttgccaaaagagaatcaccatgtgctgtaccttcatgtttattcattccacatgtgtttattgactgcttgctctgtgccaggcatcagggacagatacattccagcacacctattaaaccctccagccgtacaacagctctcgctctctgttgagctatctggccacctaagtggttgggaagttcagctcgagagcttatttaaacctgcctcggatcccagggagtctccctgcaatgctgtggttgctctcagcctggcctccagtgtgcgagagtgggatgtgggttaagtcatgtggtgctatcttggcttgataccatgggcctgctttcctttcctgtttatgtggatctcgggtgacgttcactctcacttctcccaggcctgcaagggccggactgctcacgggagggatgtttcccataagatgtcatttacgatttctctgcctcagacatcactcaggttgaaatgggactgaagtcttgtattttacacaatctttgatcccttgtcaggaaaagcattgagcacttctcctctcgtagcccacgtgactcccctgcaatatctcaggattcctcgattttaaaaaccataaattagcaaatcatcaacatatcaccggggaggttcatctggtagcgattgtagtcagaaggaaacatgggccctaataactgattttcacaaagatacaaagaattgtagacagacagatacagtaaataggaagacaaatagataattcaagctgacaggccatcttgaactgattaggcattctgctttgattagcattaaactttttgtggaaagaggaaaaaaagaaaaaaaaatgttgccctcatactttgggaaaacgacccctgatgacttctgaaattgggcactgagaggcagatcacagcgcatttggcattagatgccccacatgatgtagtgtcccaagtagtcctttccaatgacaggggccttggtgggtgtggatgcagatacttcctccttggcatctgctttgggtccttctcaggcacgtctccagtccttttcaaacttgaacatctgaaaagagacttggctgcatagtcaatcaaactctaggtaatgcggatgggatgaaggcctcccctctgccccccttccctgctgtctttcttcccttccacacacttagcagaatgttccacctattgttctctaaacaagaatagaaatgtaggtgggagatgaactgggtaccttgcggggtgggggcgcattcaagcatcgacttttgctttcaaatatcctacctccatttacaaaggaattctgattgtgaattttctaattataatcccgaaagattctttctgctcagcctcatgtttgatggagtgagtccttgctgggtagatttagaatcccaggaacaaatgcaagcatccgagactaagttgcaccctattttctgtcttcctgacatgccattcattctgatagaagtctttccagagttgcgacgagcagttccttgcagacttggggttctttccaccactgctgtcaccatgctctgaaaataaaacagcaaactttctcactggccaagtccagcgtctctttgtattaaaatatcatagacatcaatgcagcatgaaggatgtggaaatctgattctgttgctgtcagagttgaacctccatacagtactggtattacatggcagcagcctgctcctttccccacaaccgtggagatttgctctgaccgtgggtaccagttgtcagtaaaggtcattggctctccctcctctgtgcaattccaataaggagatgtggaggcagatcagagatgcatgatgcttctcacagatgccaaagggtcttgccagcttgcatctaaagcagatttaggaaaacacccattccaacacactggctcaacaattattcaaaccctcccatgagccgggaattgtgctggactccgtggtgaagaggagtaagagattgtgattgttgctctcttggagagtatgtgagaccttgtccaatcagagctatccaaggagccagtggcagctaaacgggagcttgattatgtagtaacatcatcccagtgagatgttcttttggctggaatttggtacaataaaatcaggaaggtgtgaaataatcatgaaggcaggaagcacattagagagagtgttcctaagagcacacgataactcagtgtgttcctaatgagctcactggggctgtttagggtagaggtaacagcagaaagccagtgtgcctaaaaatcttacagagctaataagcaacccaggaaagggggctgtggtgacattcaggagggcttgggacctggtagtaacattgggaagtccctaggccagacaggtatccttctgtgacatatcatatcatgcctcagcaggcttttgagtctatggctccttccaaatctcctgagagttgcagatactggcattctatgaaggctaatgccagtagagatgctcttcaacatcagatggttgttacatcctgataagcccattgtaattggaaaataacctgtacataaaatgcactcagtgtgctttacctactgagcatatgagtttaaacctgcctaacgtaaagtctacataaaaacattagtctatagttgggcaaggccatctaacacaaatccagtgttggataaaccacataacttgtttattgtcaaattgaaattgaacagaatggctatacaggtagcctttggcatcagtcaagtagaaagcttctatgtggagcctgcctattttggagagcatctgtatgtattttgagtatgctcagagagaatggccagcaacttttgctggcttaggcagcacccattgggtctagtgggtgagaagggaggatgcatctggctgtcacagtgagacagccagtcccagtggcagggtaggatgcatgacttgccaggtgtgttagggagaaaggttgcactcaccttacaaatcaatatcattcccaaagagaaaactataaacattttacatgtttggaattattttttcctagtccaccttcatttccaagtggtgaggctggcctgtttgggtcagtgttctctgagtttgtccaggtaaggccagtgttctctgtgtttgtcccaacagcagatagagacagggaaagcttctttgatctaaagagagaaatgctgttcaggaaaggaaactgcctaggatgaaaaagttcgcatcaaaggtgtcctgctctattgagaatggctaaggatcaccgagtcccaagtaatgagatgaatgagatgtaaaggccagagtcaattaggagacccaaggaagaatccatgtaatttgtggttgcatcaccatggtacaattagttattaataagtctgtctaaggcttgagatgaaggccaatttgtagaggacttgctgttcaaatgtaaggtcctgagttctggatccctagaaagtatattttaaaatcgagacacaggagcacatatgcataatcccagagctggggagtcagagacatatggacccctggaattcactagttatccagcataaccaaacctgtgagctccaggctgagtgagagatctcatttcagaaaataatgtagagagtaattgaggaagatgcctgatgccagcctctggcttccatgtgcacatgtgaccacctgtgcatgtccagatacaaattcccctctctgaaaggaaataaaggagaaaagagttagcaaggtggcagtgatgtgataaaacctgaacactggaatgggtgggttggggagcaggacagggggaggatatagggggctttggggatagcatttgaaatgtaaatgaagaaaatatctaataaaaatataaataaagaaaatatccaattaaaaaaaaaactaatgagaaactgaagcaaaggtcaaccaatctacccttagagatctatggttgtaagcaacagagatggatttttgctgactaagcaattttttaagacccactaaagtaacttataaaatccaggagaaatctgaagagcaaggtcccagaaaggacagaaaacagccagaaatgaggctttgccatccaggaagcagaaattcatggtcattcattacagaatttggccaccagcgtggttcagttgttaccattatctcgagcaatgattagactctcttggatgtggaaacttgattagaggaaacaaaaccatgtgtaattaaaagtgagatatgtttgacagaatgaatggtatatgcttgataggtggaacccacgcatgctaaggctgtctttgtcaacccttggattgaaagtccatggaggttacaagctacaagagatgtgtagtcattccttacctgtagactgactctgaccctgtgtcctgcctgattatggagatctcattatggtttggaatggtggctgagttctcagctataaatgacaaagtgcatcagtttttcgggccaagttctgttaaagggctccccggtctcctctgatgggtcgttcaatgctctgttccatgaccttggagctctgcttcatgaaggtgcctttgctgtttggatctgtttgctctactgtctgccccatttagtgaagcagtaaagcagcctgccttttccaaaatattcctgttgacagctgcgtaagacgattgctccattctcttcctcaccgggaggcacatcacatttccttcctttctcattagcaaagcactagatgtggccaagagtagatgatcttagccttaaacctgcttggaaatccctttgccttctcatcctttcctttcctttcctttcctttcctttcctttcctttcctttcctttcctttcctttcctttcctttcctttcctttcctttcctttcctttcctttccttcccttcccttcccttcccttcccttcccttcccttcccttcccttcccttcccttcccttcccttcccttcccttcccttcccttccctcctttcatctttctttttatccttcctttttcttacaggaaatagataactattttatagtcaggttgtgactgtgggcatgataaatactccatggttttgttttcattttttgctcctttatggacttggggaaagatttctggaggctgagttggacagccattcttacagtttactgttcaatgttgaccatgttgcctctgccttagtgtccaagccaagcatacttttgcaacaaataagtcttgaaaacaagtggcatgtgtctgtatgtgcatgctgaactagagctagattcttggctaggatgggaagacacaaacaacaggctctagtcagttttctttgattgttggtgtcagtctttccccatagtcaagacagactcctaggaatagatttttttttaataaagaagaaagaaggaaggttggaatagatgaactttttattctgcagtgaggtcacaagccagaaggagaaggactgttctgaaggcacaactcgaatcagggccagttgccttaagacaacacagtcagaaagtcacagctgggtgatgtgacaagtgaagcccaggtttcatgaggaagaaaaactcaaatttaacccagcagggcaaacatgagcttggtactgactaccatgaggcctgcagggcctctaaccacccaacttctgtgtgacaaaatgctacccattcttcttgccaagcgctccttaaaatccaatcgactcactccgggggctgctaatggtaggaggtgctgggaagatgtgggatgagagaggcatgattagaaggctcagcagaaagacagaagagagtctagcatatgtatttgatataaatattatagtttcacagagacatctagatcaatacatgccacatttcatctacctctttgacaaagtgagtgcaatgtattcagaaaaagctgtataggattttcaatttactccgtatgatttattgtgacaggatggctatgggtttcttaagttctttatacttgttccagtaaaaatggatatagtatctttaaaaataaacagcccagagacatgcattttatactatcttctggtgtgaggcctggctaaggagagatctaagacctccccgaccttggaagacctgattgtggtcagatttgcctcagtccttgctctttggcttttgggagactgagggggttggggggtgggtaaacagggaaatcaatcaggaagggattgcagacgtctagatgagataaaatgatgacaagaactagcgtataggcagggagcaagcaccccatagggattcatgagggtctggtgagtgaggtcctgtcagcctcttcactggctccaaatcacagaggcctgaggctccacagtctcttgttacctagtcaaggtcatttccacctcatttgatgatgcttctttttagaaggcatcaaatagagggcgctgttctgctcttcctaagatgcaccaaatggctgagcatgtgtcctcatcaaaaaaaaaatagaggcattagacaaagtgtgtgccatagaccctctgaagttaagatatactcagacatctgcgtggggacctaccaccaaaacctttgcatggtgaagtgtggaatgtttcaaaggtggttggatctcagaattactgcctggtgtgtgtgtgcgtgtgtggaaagtgtgtagatttttgttttcatcaaactaaactgactctcaataactccctgatggcccatcatcagagccttgaaaagccccatcctcctcttatacctcttgccctaaggccatcctgaaacagcttgccactcaaccctggaatgttgggcttcctggcccaccagaacaacacaagtagagtgactgaggagaacatagatgaccacattctagaggtggaggtggccagtgatcagaggagcactcataactatttggtgatgaatgatgacctatggcataagtaagtggcagttcccagttaccccttagagagtctagtgtagctatacattggtctattaagatgcaatcacactcaactatgagatgccttagttgtggcagtctatctatgctacctatccctaattaacccactctttagggccctcactcagtgccagtactggataaataacttccttccaccaagtcatttgctaccattgtgttaatatttaacacacttccttgttcatctgagatggatctttcatctaagccattaatattagcttaaatttatgttacctttgcctcagaaatatctgttcatccatcaagctttgtcccacctacacgtgtcaatcagattaaagtagaaatggctactgatttagatctgttgtctgtcttcacagttctagggatcaaggccacatagagtccaggcatgaagattagcattgggctcaaagagccagagccacacatgaaaatggtttggttcctttcagtgtgacccatttaaataacttctgctgtaaatagtgatctctttgttatccttcagattcctggtctggtgggagttctcagctccataggaaagcaaagtctggtccagatactgacattccttttgtagtcccttattttctcacagtgtatgagtaaagttaaagtttggtttagagtctgtgcacagtggctttggtaatttctatgtctcttatttttggttgttgtttgttttcttgaaccttctgggacaattgagcagtgtagcttacactagagatactgagaaactatgatgtcttacaggggaattttgtctttgtccatcccattcccacaacaaacctctctaaacctctaagaactgcagtgcctcctcctccatgctttggctaatcctgcccaccctgagggaaccaccttcttctgtcagctccctctccttgagcactgaagtctcaacacttgggctatatcccaagtcagtttcttttacttcctgtgaacataagagatgcatctcacagaaacaatttcagaggggtgatctaaagatatgcttatggtaagaccttgcagttgtttgaggattcgatggaattatacaagccacatgctgtgtactgatacaaagatatcacacagtccctacccgtttaggaggctgatggtagctcctttgctggcccatccatctattagctttccaagaagatcttggagataacctcaggaatgaatcgctcttcacagtgtctataaagctctgagttgttgctcctaagatgaaaaattggtgagacctgtcaaggactatgtaattaattagtgtctgacatcagagtatgaatctcaccaggcaggtctgtaggtatcgtggaagccagcagagatcatttggacaagaatctctgaccttcctcaaatcatgccctgtaaatatccactgcttccaaggagcccacgctctgctctcaatcataaactattttcagtcatattgcataggtgggataatatgtatcatgtttcttctttctgaagcaatattcctccccaaactactgcctgcaagatgatctccatttgccaacctttccccacgctcccatagggagtctggagcttcctcagacgtgggccgccaggtctgatcttccagtgctgatacagggctagagatacggcatctccccatccatcaattctgacgacattcaaacattttcaatatgtgggctccctgataacttccattgtatggaaaacaaaatggagggaaatgattattggcacaaagggggaaggccgtaaatcttcaaatcagatacaggacagattggaacaatatggcttcttcaaggttgccatgataatgtacctaataactctccctgggcaaaaaggcaatctgctttcaatcaatcccctacccccagcgttccccccccccttccttctgagcaaaaataccaattatgttgaaggaagatttttttcttccttttttgataaggactgctctccaccccagaaatcatgctgtagctaaaagatatatattttcaattgtctagtatggtatcagacagctagcaccaaattgaaaaaaaaaaaagtcaatctttttacccccttcctctctcctgccagcatttgtctactcacttcttaagagaagtgaaagctaattaaaggcttaagggataatattgattgcattggaatatattttatatgtacccggcacactttcaaataatagaaccatgactttttctaaagctaaataaatcagctggctgaacctttgattcaagggtgatgtgttggggcagggctcatctcctccccttccacttcacacatatctctctcaggatgaatgatttcagagcagcaatgggggagggggaaagatgcatacgccattccttatgtacaggacaggaagggtgaatgttcagctgtctcgagccaccattcatttgagtctggccttgaataataagcaggcatattctagcatagaacgctgaagtttgcaatatccgagacagaggcttagctaggtaggatgaagttctcagcttctcctgtatggactggaataagtagcttgtgtgggacatcctctctttgccatcaaaacagggaactagagttcttccttacctagcttgctatctcagctaagacacagacagccccagctgcagagatacctgtaaagtagattcctgtcggagcattctccttcctagtgtctttgtgcaggacattagaattcagcagttaacactattatcacttgtgtggagttgaagtcagggggaaaatcctccttcttggtcattctctggacatgcttgtcactttagaatcataaatctcattcagaacctgcatagctaccacattttgcccatacatgcactcatgctacaagaaacattttaagatatgatgaaaatggggaaaatccaaatagtttgtttattttgtgaattcagttacatagtatacttcacagccttatagtcagaagggttcatgatatggaggttcgggcattaagtttggatgagtggctaagtgaccccccaacctagcaggtgctgttgagagggtgatatgatcatgttaggatgtctcttctgaaggactccactgccacccttccttcaccttcatgaccgtggcttgcctgattgctaaatgcaccaccgtaacaataacagttcataatggcaatattattaactgtaccgcacatattattgatttactctttgttctgcaccattatcctttccccaatgagtatactgcattattctcacatccttagtcaagcaccaaattaccacaaaagggcaggctcttgtaatgacgtctaatgggacatcacataaaccatcaccactgcctcctataataagctgcctccagccaatgagcgttctgccatattgaaatgcgatcagagagattataaagggcaaaggacctgggcactctgaatttttcctgggaaattgcctcactgcttgttcaccacctgacgtagtcttaaaacacactagagatctatcctctgtaattgtcagcctgcaaggtagagaggggtaccagttcagctatttagcacagtgactttgatagaagccaatgcttatggcttcatgactaagccttttggtcttagggccaattttcagatcctgatcttgtgattgagtaccatgaagcatatgtagtgaaccaaggatacactgatgttcaggtcacattggtttaggaagaaatgctagagaagctgcaggtcttacatgctctggaaaagggtctcacttccttgggatgaatggatatttctagaaacagagttcaaactacgcttgaacaaagccaaaattttcacatccgttacatccctggctcctgcctattggaagggtcttcaggtgaattagtttagctcttgaaagcctcaatactcagaggcagcagccctctggggacacggtcccagcagccagcttgattgtccattccatgggcatcccatctccatttagccctgagtaatgctcacttactgtaaagtgttacatgcctccattgttggagaagttatagtggaaaaatgcaaaatctcctttttactgcttatggccagccgagcctataacgtgtcaagccgtacattagccaccctgataaaagtcctctttcttacacacaaaatcatcgtttcagcaagatttgttatctcattacctgataagctgtatgtcataaaccaagactgctgcggtaaatctcccaggagggcgctttgtgggcagaaagggggagataggaatctgcaagggacttgataatgtagcatttaagcacaagcgtaatgtcacttattgttaaatgcataaaaccacttggccaagtggctgggcttttaataggattttgtgcagcatcaggtgagcagccatatgcctttttttttctgtccaggagcctctgagcaactgttagtgatatcgctttgcctcatgaccctctggggatgggtgctgggtactggggctgagtggggagatgtattgcttcctctgctgatcagagatcagggtacggggtcatgttgctgagtctggttggctctaactgctttctcctgtacaggcacattgtagtctgtggacacattactctggagagtgtctctaacttcctgaaggactttctgcacaaggaccgggatgatgtcaacgtggagattgtctttcttcacaagtaagagccccctgctgccaccagaccctgccacctaaactcatgcttctctctgagtgcctagaggtggctgggaattaggacagggttaaataagccatgattggtgctggctccttaggtaagaggtagtttttctgaaagaatggggaggttactttagaacccttggatcatgaagcagcacccttgttcagagctgaaagcaaactccagtgaggcagtctaggagtatatctgagtttctttctaaaagattcaacagtggaattccctagtcatccaagttaccacccttgtaccttcctcagtgtggacctttgcaatcggctgtgtctgttgagctggggtaggataattaatatagtcgtatggatactttaccaccgtaggagagggacaagcaggagaagaggagaagaaggctgacatagttacgtcccacactgctgtggcaaaccacctgacaaaataactaaaaaaaaaagaaagaaagaaaggtctgtttctgcttgcagtctaaggatccatagtgacacggtaggagaacacggtggtgagagtgtgaggcagccgttcacactgcatctgaattctggaagcagagagagatggatgtcagtgcttagttggctttctccttttgtatctagtctgggaccccagcctataggatggtgctgctatgttcatggaagatcttcctaccccctcagctaacccaatctagataatccttcatttaaatgctcagaggtttgtctccaaggtgattcaggaccctatctggttgacagtattaagtatcacacaatgttctacgaatattgatactgttgttccagagtttccatttggctctgtgcagatggattcccatgtactccacagacatagtgcccattgcttctttagttaatcctcatttaaccatggacttcctgggcaagttacttcacttccctgtgcctcggctcccatgactatgaacagaggagacaattctacctccttggactatggtagtaacaatgaaatgaatcactccatgtgaagtgtgcagaacccagttaggtatgcaggaaatgctcattaaatgccagctaaaattgtgaaagaaaatctgactaggctatacagttgacttaaggatagattccttccatgtaaatacatttaccatgagcagactcttgttagggcattagcttactcaattctggaggctgaggtgttccacaatgtgccatctccaaattgaactccccactcaatgagtcaatccaaacttgaaggcctgaagcaaagggaggcagtgatgggaaatccttgtccacagaggaaatggaagggataagatgtcatggtgtaggtatataatgaccaatgaacactgatgctacaactctggatttcccagtgatagcaaagaagaggacagataggccctactctttgcaaggctagagaccttttcagtggactgagtgggtctgttctcttgaatgagtctttcatttaggtcagggaaggaggcttctctgaaggtcagggcctttgttcacatctttgtgtggaaatgaacaccgagggagccacagatctcgctctgctgctttaacagctgtctctcttctgtctctgcagcatctcccctaaccttgagcttgaggctctgttcaaacggcatttcactcaggtggagttttatcagggctctgtcctcaatccacatgatcttgccagagtcaaggtaaggagaaacaagtgttttcacttctctaggggtgaggccatggttcccaggtaggcagactacaagccatctcctaaccattaatgagatgattcagatgttgctaactccagtccactcgttcattggccccaggaggtcactctgctgggggctcactcaagatcatcgataactatcacacactcaggttagtcttaatataaaacctaactctgctgttttctccaaaatcagccgttcccaatgcaggaccatcccaataagggccatctcatcccagcagttcagtgggtaaaggcatttgctgcaaagcatggtggcctgagttagatcgccaggatctacttggtaggaagagagagccaactcatacaaactgtcctcttgctttaatgcacacaaacacacacacacacacacacacacacactctctctctctctctctctctctctctctgtctcgagagacagagagacagacagaggcatagacagatgcgtagacacacacatacacacatacagacacacatatatacacagaggtatagacacacacacacacacataagtaaatgagagagcaataagcatttccaagaaactatagaaaaaaagaaaaaaagctacagttacttaagacaaaataggactaagaaaacaaacagcaaaaagaataacaaaacaatagcaaaaccacacacgtttcaacaatatcttgaaataggaatgccaacaactcaatagttgagggacacaaattaggtgaatatcttaagaaacaaaccatctttttgtcatctgcacaaatctcatgtaactttcaaagatggccaccactttaaggtgaaaaaaatagaaaaaccatcctaagccaatgggagcaggaagccagcagatgccaatactataatacccccaaataggcttcaaagtaacacccatcaggagagacaaaggacacttcatgctaatcaaagcaacaattagcaaaggaaatagtataatattaaacatatatgcaccaaactctggtacgccacatttcataaagcatacacttgggctgaaatatacagaataactccaacgctataagaatgggtgattttaatactccattttctctaataatacataaatgtagaaaagtttaaagttgagatggcttaaaaaggcatgcacaagagagcatgatgaatgattagccttcaccagattgagctcagtatgacccccaaatctattattgtgtctaaaagaaaattacagaaagctgtaaaccatttgagtatcccttttccaaaaccagactactatcagttggtgataaggtcatcgtattcttcctggacccctcaaagcaaccatcttaaagtacgtgcaaggctgtagaaagaaagggacacagcaaaccaatatctgctattttatccatcaagtccagttgtcataagtatgcacaacacttgaagttcattaatattatgtgaacccaaggaaggctaaatgctgactgtggccaccaaagagttctgtaattgctatagcagcaaacatagacaatctgaaaggacttgtgtaaaattctttacactattaaacaacgtgtggcataccattgagggaaccagggccctcctaacaaatgcaggaacagcctaggaagtgtaacactatgagcagaagaaagtgcagacccaggttagcatgagaattctcatgcttatgaaggctagttcatcttaatattatccagacatgacccaagtcataagtacaaagaaaatggcttttgttcacaggcctaatttaaatgcaagcaattattagcacatcaaactcatggtctgtctacagaacaaacccccttttggctcacattaagataagtcactaggttgccttttggatccatctgcaacttatcatttcatttatgtaaattatttgccttttgaatacctgagtagcaacgaacagaaaacagcatagagctgttgtctattgaaggctctgatttctcactgggacacatggaatgaacatgtgcataaggtttgatgaaagaatttttttttaatttttcttattttaattttatgtgcatgagtgctttgcctgtatgtgtgcatgtgtactgcctgttgcctgaagtctacaggtcagaagagcgagtctgatgccctggaactggagttataggtgccgtgagctgccatgtgcgtgctgggaactgaacttacctcctttccaagagctgcaaacgtccctaatcactgaagattcggccccttgatgatcagtccgtgttgctgaatgtgcaactgttttgtccacatgactatctcggggaaggggtttaacccaccaacctccacttcctggctggaaaaatgaggatgagggcacaagacagttgaaagaggaagtagggattagattgaacggcctgattaagtaaatttgaaggaatttggcaaagatgtctgtaagcagctaggccaaatgaagaacataattactcagattcaagctggaatatttatcctttaacaagaaccggacctacaacctacacttttgacaaaactataatttatatatatgtacatatatatatatacatatatacatacatatatatatatatatatatatttccttgaaaaaataccaggttctctaaaatactggtagcaaagagagactgcagttgagtccaactatatgtttgtgtttattatgatttttttccttttggtctctcagatagagtcagcagatgcatgcctgatccttgccaataagtattgcgctgacccggatgcagaagatgcctccaacatcatgaggtaactcaagggatcaacaggggaaggtcttggactggtctcccaatagcctgcatgcaaccttttctttgggtctccagaggactgtctctgtggactgcctttccttcatggaccacagagcaatggctcctgtacagggatgatagagctgaagagagcattgacatacagggtaccaaagagagtgtagatatacagggtaccaccaataggaagttcagactgagaaggtgccatgctgatgctgatagtgcctcttgggtttcagattcctagagaaagaactaaaaaaggaaagagagctgcaggtctgagttaaaatgatatgttcccagggctgggagcacagctcagtttgtaaaggacttgctatataagtggagggggttgattttgaaccccagaaccaattttttaaggtgaagttctttagcacccttgagtctaaggaagcagagacaagcagattcttgggactcactggccaacttgcctaacctaattaggtaagttgcaggacactgagagaccaaggggtccacatttaatgaacaacattcagtgccaacttctgcctccatgtggagttataccctcacatagagatacatacccataaaccttaatttttttatagatttttaaaaaaaaataatatgttacctgaaaggaattagacctaagatatctttacttgggatggtcttacctcaagcaggtgttttgcatcctgtggagatctttgcactagactcagctagcagaggggattgctggaaccctgtgtatagagaccagtcatactgccaagtgtcccataatgcatggcacagtccttatctagaagactgtctgacccaaagtgctgatagctgaggaatcctcattagtgcttccctcgtgtgtttgcatcaagttgatcattactgccctgaaagctattggttcgttagcttgtctcagattccccagatgtgtgttatgcagtggttttaacattcatatgaatttctgagatgctgaattatatagattatttcttaatcctatttggattgaagtctccccctcctcatcttcctcttcttcctcctcctcctgctcctttcttttaatagaccatggtctggggagaaaacaacctagaccgccactagtttgtacctgttctgcaaatgggctgggcctctcagagcttaattttaactccaactctaatgccttaagttactctcacttcagataaaatgttttctttagctattattcttcccatagatttgtcatcatatcctgtatctataaaatcacacacacacacacacacacacacacaagaaatccaaacatttttctctcattagctaaaaatccttttagaatttgccttttctgtggtataaattatggaagagtcctttgaggtaggggaggatgataaagagaatctctggagagagcatggaccaggggaaagagttcgttcacttccaccatatccccagcaactctcccttaagagtgaacagctatcctttggaccaggcatgctccaaaggctacttgcagtttgcttctctgggacccatggatttacctcaaggtgagagttgagaagttgcccttggggctttacagtgctcctgagaacttcctcttggctttaccgagtgtccaccagttacatgcactgtcccatcgatgaggcagaggaattcctctccgctcaagtcttcccatcagtgtcttaggtctggaaggagccatccggcatcatctctctttccattcccattccttctgcagtaggcttggtcccatgttttaagaaaatccatgtataatgacttggtttgcatgggacttcacacaggagtacatctccttcctggtcctccctagaaagtgatcccataaatccacttcagtttagaatgtctcccttgtcattttccaaatggaccaagcggcatttctaccctttgacacatattccccgccccctttttatttaaagtgataaaaatgtagtccctcaagagacaaggctctatctctttccatattgctaacaaaccaggaagatgaaactcatggtgttgacctcacagtgaagttcctggcatatatactttatttcttctgttatggtgagaaatagaagtgaatagttactttgaaatgggcattgctcataattggaatattttattcaaaccctgagcatgaaggggtgatgtgagcacacatgggtaccagggggaattgtgggatgtcagggtatagaactcactgggtcaggatcataactaagctgtccactatggagaatcaggaggaagacccaaaagggagtgggaacctcagggttaaacgtgggctcagcttttcttttatttgtatattcctccttagcttaatgagaccaatctgctgcttttgaaattaaaatgtcaaagaggcatttgaaatgagctaatgcagaaagctgcctggcgctgtggactgctccaagaggctgataggctcaaaagccttgagttatacacagaggccaatatgacacactctctcaaaaataagagaggaagtccttccagtgcacagtgcagggaggggctttcttggggaccgtctcccgactgctttggctgcagtttccttagatgaggctgctgtctggtggccttgtttgttccccactccagttttgcagaaagggtggcaaagtgaagagctgagctcagtgggaagtttgcgggggcgggggagataattgtgcttgcgttcctgatgaggcttaggaggtgggccgttcactggaatttcattctttagccttccttgtcacagaaggaaatgtacaatgtcacctctgacagggttggtaatgacaaaagccataacttacacgtggagagagggcttttaatgatttcaaagcattttaacatctggcttcacatttgtccctcataccaagcctgtgaagtaaacaatgcaggtaccgttgccccccatgtccagatgagaagacaggaacagagagccagggtatttccggagggtcacccagttcattagcacaatagctgtgctggaaaccaggtgtttccatttctgggctccttacatcttccctgtgctggtgtgattgacaggagaagtggtgccagggaaggttggctggtggggtcatccaggctcagtaaaggtctgagggcaacaagaggggatttcccaccagatcaccatctctgtagggtgctaatggttaacttgaaccagtggtcaagtcagcattatgctgtggaaggcagagtccttgatcgtattccaagagaactgcttaaaaagtcatattatgagaatgtccaaaggatttgtgataatcagagccatttgtcaggtggcctgtttgagttgtcaacattgtctcaagttgttaaccagaagctgggtgctgggagactgtagatccccagaggcttaaggtctaggcttgcattacctgtctctaagcatcaacagcacccatctccagtccattcaagctccaactccatttcccaggcaacacaggagtcccttgtgtttgtgtgtttgtttttaaggcagagtttcatggagcccaggctagctttgaacttgctctttcttgtcaagtctggccttagagtcctgatcatctatttccatcatcacgtggtatggttacagggtccattactacttttgcctaactctggtatttgaagtctctggagtatatgccagtgactgccttgccatttcttttttatgctactaataggtacagtgaggagaacacttttctccctgggctggtacccaaagtcccctggatggccctggttgctaccttagttgcagtcacctagttaactgaatcttccatcacactccaggttacagagcctgcttcaggtctggttctctctctctctctctttcagagtgatctccatcaaaaactaccacccaaagatcaggatcatcactcagatgctgcagtatcacaacaaggtaggtgctgagactcttccagacctgaaggcatccccagagcttgggtcccgacaccttctccctctccacacagcctcacatacacatactcacataagtgcatacatacacatgccctgaggcagaaaagccatagttaaaatgtcccatctccctaggatagctcttcagagaaagcagcttgctttttgttttgttttgctttcttttgttttgcttttgttttgttttgttttgttttgttttgctttgctttgctttgttttcgtggtgggttattgggaggaagttcctttgttgccctcttgtgctaattcattctttcattgaaccctgtggctcagaaatattgatatgttcttagatcctgtccagacctaaattccaacaacttgcgtttctatgtcctgcagtcattcagtcaatagctattgaatacctactctataattaacactcctcctgctactcaaagggtaggataactaactgtgaagataaaaatctgattttgtgtccttagagaccgatcaaggaaggtgtagagactttaccagagaatcgaaggacttctctatgtgtgaccaggcacacatgaaggaacatagtataagttgggtagagaaagcagaatgtgacatcatcctcaaattcacaatgggaatctttccagttatacttagggaggtagtagtttatccaaagattatacttaaaaaatctccccagtgttacagcttctagtgagagctggttagaaagaacatgaacatgagagttagtattgctgtcctgtagtttcctctcactaaatcagaggtgaaggtctcttatccaaaggcagcactccttcacctggcttgtggttgagctctctagacagctttggaggaaggaaaatggcgtcttgttctacttgatacaataccagttgtcttcttaatggagcttagagactggaggtttctcagtacctggggccaggtgtcctgactgaacagaaataactccctgcaggtttatgtgtgacagcatgccccatcttataggccatattctgtgcaaaacaagccatcaggtgacccagagaaaaccccactctgccaaatgccaccagcaccattccattatttcttaattgctggcaagtgctggcccattttgctgtgtggaggcccatcagaggccattgctgagtgggtcctgctgtcagcaactggcccactgcttggaactgctgcccagtgccgaccattgcccagccctcggcaggtggctctattggaaattctgttactctccagccagtgggtttggtggtgggcactgaaggtgaatctcctgtttgtccctgaaaactcaaggataggataaaggagttctcagtaattcacaggcatcaacctggagaagttcttgactgaagtctctgtaggtggaggtggattttattagtgaggctgtgactggtgacagctcctgctgcaaggaacactccttctttcatttgtgacttgaaatctcatttagtgtgggagtgctttaagcgattgtttagatttttggctgaatttagactgaataggaaaattaatgttgtatgtttagaaagagatgtcagttccttttattctctttccaacgtgtgctgatgtagcatcttcaagaaattaaggagtatttcagctgtgtagttcttgtcaaactggaagcaacatgactagcctcagagccagatggtacctggtcggtattcacatgactacagccgcccaaatatcttggacagaatctccaatccatccatttagatactgtgatgcagacatcaacagacccaggagtatttccttaaaaggcatctcatttagaaccaccccactctacttaggtctctggtcaggtaaggtcattttcagagcactgttagattagtgaggatatgggaatagagtaacttcgagacagggcagttttctctctttctgcatctcccttttaaagggagaattcctcttgcctttatttttcagatcattcttagatttttgagtagatagttcttcccccccgcttcattactttgaattttcctaagggcctcccacccacctttcccacacactcttcttctttttcaactttttcttcttgtggccttttctctgtgcccatctgagaaacacatagaatgccacccatttatacacgtgcttgggaaagacctggtgtgtgtgtgtgtgtgtgtgtgtgtgtgtgtgtgtgtgtgtgtgtgaaaactatgccaccaggagtatattctggagggtgtaattgctcccacagttagacacaaggcttgaaataaaaacactgtcaaatccctgtgatgtaatgagggtgatattctagagcccagagggatgcagggaaactgctggccttgagtttgtcatcataacaattgcagacatttgagtcctgttttatggttttaaaagagctttgacatccattatctcatttagtcctcattgggccatctgtgcattttagcatcccagtgtaacttcagactagcaggagtcaaagctctattctaggcctatcaactctggtaagcacaaatcaaggtcactcagcagccagcaggctaggacagtatagccaactgctaccttctatgtgaatgggacagtagcccacagaactaaacttgggttcctgggggaaggatagtattctccaaaatggatctctttacagtggctaaatttcacagagagaactttcaaaccctgggcatctctgagtgcggagggaagaggtacatggttcagagctctccagacacgggatggtgatgtgacgctggtaaaggtgctcattctaaaaactcacctgttcatgcagctctcatttcccccaaagcactctaatcaaagaggctcttgtctctgatttggaaactaagccccagtacagatgctagttctttgagcatccttgttgcctatgatggcatttgggacacagccgtgttaaccagttcctttgtaactttcctgtatctgtggtgaaacactctgacaaaagtcccttcatgaaggtgggtttcgtttcagctcacagctcaaggctccatctatcatagtggggaagtcaaactaccgagagtgtgaagtagctggtcatgtcatattacacagatcagatcccattatccacttatacagaccaggattccagccagggaatggcaccacccacagtgggtgggggttccaaccttaattaatagaataaagataatccttcacagccatggccggaagcctgtctcctggatgattccagattctgtcagattggtagcacaaatcttcatgggcaactttctgtcactcttccaaatgtatgccataaaacttttggaggctgtgggccttgatgggttggccttgtttagttatgcttgtgatgaggcaactcaccattctgggagagattgatagaaagcactggattgattcctatccatcagaccaaacagatagggctgattggtgccctgttagcctcttacaaggcaatgctctcaatgacccaaagagtttttattaaattctacctcccaaaggctccacttgctcctaagagagtatcaccccagggatgaagctcttagtggacattgacgggagatgcagaatacagagtactgttgctgttccatccttagactttgtcatttttcacagtatttctccaaggctgaatatatagcaagagagagaaatgtgaccagaattcatttcttctgccttcctgaagcagcacattttcatagctcttctccatgaaatggaggatgatccgccagcataaatggagtgagggtgtggttaatgttggacctaatttttctctttgccaagctagaaagaatttgcctctggattcctgggtagaaatgctgagggtttttttttttttaccagagccaatttccctcaaataaaagaggatgaagtttccaaaaacaaaaaaattagagttcctgggtcaatatccactcttggcttcccgcacatagccttccctcttggtcattggcacttcatccctgctccctgccaccgcatgactggagaaaatacaatggcaatgagaggagacataagaagcttataatgagtatgactttccacatggggcccaagggacccaagggacataagggacccacggcttacatgtcagaactacatattttggaaggcatggggataggacagactgtgttcaaggttgtcatagtttctttgaaaatggcatggaggctatgtggtgtctttgtagagaccagaccacccaaatctcttgtttattacttggatgtaattgatcattcttctcataagagtattctccacatagatgaatgtcttttatactatgccaaggaagtaaaatgaaaaagctgacgtcgtaagccagggaagaatagggaaagtaatgagagagagggtggggctatctgttgacattcagtgtgtgatatgcagaagaccctctggtactcagctccacacaaatcacactctctctggcccacacacaggccgattttactcgggttagggaacaagcagtcattcttccatcagtgaccactgctggcttggtttggagactgtcacagaggtggattttgcaagcaggcatttcataagactggggtttctccaagcagagcaaagaggtctgggctctgctctttgtttctgcaatgtagtcattcatccttttattgcaactggcttctgttgttccaaaagtgaaggaaagactcttttgctgctccagtttgctgctatgtggggagaaataatttcagagctatagactcctggattatacaggtacttagaaagactctgggtcaacttcttctgtaaagcatgatttattatagcattttggaaaaatgctaagtcttagccataaagtagtattctctatttattagacatatttcatccatagaaagttcctttgtcagacaagccaaacccctttgcttccttttaatatatatcaggaaagtcctagatgtgaagctaatcatgacatagcaggacttgaggcatccagatgtgatgaccagcctatgtccccaaggatgtccctctgtatcttgagcatttctggattgttttactgtttctcaagagatcttttccagaacacttatctcctcttgtcctcctcattgctctctggccattattcaattggtcactttgctcttcaagtttgactgttaaaactggatcaaatcctgtggaatgaacatggcctattcttatagaataaagagtcgtttccctttgctctggagactataacaagcaagctttggctttctgtgtcttgtatcccatggcctctaatagaggtttgagttaactatacacttaactgctgcgccctgctctctccttctctctctctctctctctctctctctctctctctctctctctctctctctctctcatacactctcttagatccatcttcttgtttcaaacctatatagtcaatatttttgaatgtaagtgttgaccctgacatctagatcttctaactctcttctcttattattgttatttgtaaatccccaaacactagagaacttcccgaatttcagttttttccctcactctgccatgtacaactctccactgcatgccactggcaaataattgtgtgagcacacctcagggcctgggagttgggctctgacctaattttgccataagagagtccatctgagagagattgtaggatgtctttatctttgctgcacagtggcctccagggaagcagcatttcctctcacatgtagaggtacaggttctccaactctaccccagatctactcagttagaaacttaggatggtgggggctagcaacctgtagtttttgtacacattgcagggtatgcagaaacccactcaagtttgggacatccctaatctagattattgagaaggcaggaaaaaaatgcaagagcacacagacacacaggcatctggcaatctgagatacttgagagccactttaaaaacaagctaacttgacttcttaatgctgggggctggtgtgtctcacaagagaaaaatcccctctggggtgaatctggctaaacagcaaacttgagaggaggatgtgggcctggtgagtgtagaagcaatgttgccaagaagcccaagtctgatgaaccagaagaatagaacagtccttagacccaggaagagggaagaaaggaaaagtttggatgacccggtgtttttggactatgcagcaattccaagaagagatttcagacactcagacatggagcagaacagggtctcatacctcttgttattcccacaggcccatctgctcaacatccccagctggaactggaaagagggtgatgacgcaatatgccttgcagagctcaagttgggtttcatagcccagagctgtctggctcaaggcctctccacaatgcttgccaatctcttctctatgaggtcattcataaaggtaacgtcttgtcttattagagcacattagcctaggattccatttgtcgtggggttgagtacagcacagcttaaactcaaaacagaacgacgggctttaacttctctggttgagaagaaattccttgttacagatttgggaaagaggccagctcctttcaaaattatgtttttatttttatttggcacatccgtggccattaaatgattgttcaaagcacaatcctctctctctctctctttttttttagataaaccacatgtttatctatcaacaaagcctccgctgttaaaacaaaaatatgatttatatacattccatatggcaccagagtgcctaaagaaaagaattatcattttcctcttttatatcaagtggctggtggacctctcactgtgtggataaatgcagaccatgtgtttgtgccgaagcccaaaccccaacaacataattcatttatttacttctgcacaatcaaggaggccagtaaggctgacatgccgtggctatttgaatggagaaagaaaagatgaactgagtctttaccccaagagacgtgcagtctggatgtgttcatctccatgtcagagctctctgggcagccactcccagtctccagatggctgctggaccaactagtagggggaagagaatgaacctatccagttctctaggacccagggccttgagtgcctctgcatctaggtacctgaccaagcaaattttctggagtgtgggtttaggcagtcaaggtggcatactacattggtgaattgtgttacttagagctagaatgtgactgttagatctttacttttgtatcaatgccattggcattgcttaaccaatagtaattggcactgtagttctcatagtatgacttagagaataactcctgttggaccctgcttgtcatctttgtagcagcgttcatagtgaacgacaacttgattgaaaatacattctctcatgcttactccgtgcccatagtcctcagctcaacagaacttcaagttcaaacgcagttacaaataaagttactgcgtgcctctagatgtcttctttaatccagtctctttgtgtcctgcatagatgaaactgaatgcaggcgaaatgggagtcacagggaggtctgtgtggctgtgtttagcgatgggacaccaaagccagatgtagccatgtgtctcccaggacttgtctgttcaatccaaggaggccagacctaggataacgaactgtcaccaggagaaccgcgctggctctttctgtggagccctggtggttttcttccagcagaggtttgctcacaggacccagcacatggtcagagggactggattctgccttccttgtgttgatgtgacatgggccttggcagagccccaccacagatggggccacttgacatgcgtatgttttgattttgtggtgcctgcatggtaactagatctgcctgtcaagaaaattaataaaatggatatgacactgattctacagtgttattaccagcagggacaacttctgcctgactttcctcaggaccctgacaggcctcacctctaaagccaaggacgttccttccagctccgctaatcccattgccaagttactatttaggaagagcctgtgggagaggctgaactgggccctggtataagtggaaacacatttgcctcccagggttacatgactgcattatttctgtccagggccagctcttccatgtttggaggcagctttttggatatgaccttttgacatggaggtggtctttcgttagactttgccaaaggcatagcctacaataacatgccttcctttcctatattttaacatttggagtagggccagtcttatttgatgcattcaccattctctgttgtcatgtgtgtatgcctctccctcagtcctagaaccacccgaggacctggggaaaatcatactccttcgtgtgttttctatattattgcaaagcgtttgcatgtttttgtttgggatgagtgtaggtggagaagagaatatgtaaatggattcttgtttacagaaatcacttccttccccaatacccccacatcctgtggtagagaactcctcaacacttccacacgacccggttttggcagcactttatcctttgggaccacttagagtttctagaagccaaagggagatgtggattcgccttctcccttgctctgggcaggttgtgtttgtttcctagttctacaggaaatattatactttgcttctgctaaaggagtaagataaacaagactctaaccatgtagaagtgtcacaggcagaagcgccgcagttatcataggagcctgttattatgtatgggaccaaaagtccaagaccaaaactaaagatagtaaggtttagcagaagaaagggatacgactggaatataggatacacaaacagggcctagattgaagatgagaaaaaaatacatgtgaataattgcttttccctgtaccagtcactctcaaggacctgaacctaggggccccataacccattaccttctaaaacctcgtcctcatttagatatgtcacctctgaattgacctgaatagtttggaatttacctttttaggagcgatggattctatggctttggttattactgtagacatttttggctttttgtttcccccctcatggctgttaatccttaatccagtccatttatgcatcagtgtgtttcccctactgttaggatgcgctggcatttataaatccatactaactacacatccaatacttttctgaaagaggcctaagttggtacccaggggttctatagctctgtggctgtttgcaaggcaagctaagcacattttttttttccagcacaaatttattgtcacccttgatgtccattactcagagccagcagatgttctggtgcctgtgacttatctcctggcctgggacatcctgtttactccctactctctgatctcctttcactggcctctcggatttcagggagagtctccttaatgtcttctggaaagaccaggacaatagacttgtttagcctgtctgccatcaccttagccctcaatacgtaggccacacattgagagcactgatttgggggagggggttgttgtttttagtctgttcagttttaacttcctcttctgcctgaagagtttcatgatgggccttgaccttccattttatgaattgagctattattcttactggaagaaacaaactatgctgatttttttttttcattttacacacacacacacacacacacacacacacacacacacacacacgagtgagagagtacaccatgtagcattgcatgtaatttgcaaattctttgtcaggaagccaatggtgagaatggagaaaatatgtaatgttagtgtggtggcttaaatgagaatatgtcctctatgtgcttggatagttgaacacttggtccccagttggtgacactatttgagatgccgccatgctagaggaagtatggcactggggaatgggctttgagagttcgtagactcggctccttctgatttgccaactctgttccatggtcacagtttaagatgtgatctctcagcttccagctctggttgccatggttgccatgcctctccaccgtaatggactttccctctgacaatgtaaaccaaataaatgctcccttttattagttgtcttgatcatgatattttatcacagccatgcccgactaaagtgaatcattttagtatctttagtttgggttatatgtatgcgctgctttgtgtttgtacaagtttgtgtttaaaaataatctgttttaagagctgaaaatataaagacctttgaataattgtccaaatatactgatttctatctacttttaaagccttgaaattaatattgtgtctatattatttttactcttctagtgccctacatatacatggcactgtcactagcgtcactttatagtggcagacagtatgcagtataaaaggaacagtcaggtagcttagaattgacaaaccctagatatcactcccaaatttgtccccaaggccaccaaaatgaaataaaggatgagatgattccttagcaagtaaagccaccttactatgtagctttagtttcttggcttcattttatggaaaccattgattcactagagattccagaggcacatatatcccaactgtatttcccgcaacacacagcttatggcttggaatcactagtaagattcaggaagcttctattctgatgggaaatgtatggacacatatttacatgctcttgccaataagtcttgtttacctttctctctggctagatctgtaagggtcagagtcattgcatcagacaggtgagaagttcacttaggttagactgtgacaagatcaagaatgacctgggctctcaggaggactggattaaggagtagggctatctggaaaaaccaaaccaactctgtatgtgatgtgtgaatgtgtacatatgtacatgtaatcatgtgtcatataatggtatttcaatcactggcagactacctatatggtaggagtcccatatcatgtagtgatgtctattcttcttatggtttgaatacatacatactttgatgtttgcatgatgaaatttcccactagagacttcttcagatgtgtacccatcattaatcactgcatgcctctatcatctctctgtctgtaatcaagggattagattagaacaggttgattcacttggcatggaagctttcttacaatgcctgcactgagctgctggagagccacagggatggtgtcgataagtttgaatccctgagaaaaaggcgactgagtatagatttcagtcctagttaaggcagagagaacagatttctaatgactcctagtttgtgtttcattaccgcttctgatggtctggatatgacccacccacagaaggaacataatctcccttattctgatacctcaaaaatattaattgcatccagaaataccttcaaagctttgtttagaacaataatcaaatatctgggaacattatgacccagtcaagttaacaaaactatctatcacaccaacctactcttatttcttgttgggcataaatttgacagcccatttctaggtcagcatgctcatcctcttgtgggagtgtggggactgtcaggatctctagtcagaccagagttgcaactgataaggcatcaaggagacaatggtaaagacttctttgtcttggaactgaaacctgcagagacgatcgatcatgataaataaatgttgttggctctgctacccatgggtgatgccagtcaaagtaaaagtggcttcataagaatgggatgtcatcacagttaccaatggagttactcttgcttctttgggaatatctaatattttaatatcatttaaatagacagatatgctcacagatttatgcctccaaccacaactcagcaatattggtgcaactgtcatgcagcattcccatttgaatgctatatctcctctcagatttggcatttccagaagctagtccctgttcttgcctgtgagcctgccctgtcccaagtcaccatccacaactggtaatgccatccttcccaatactatcctttagggttatctttggctccccatcccaaccttcctcaaataccatattcaattcaccctggcaccctgattggacctggaagtaggtgaagagtctgagtacttgccaccaatttcattcctactgatagatccaaagaaccaccatgttttctgtggctaccagccttcttgattctcaagtctagatttagcttgttttcacaaacaatgttcccaaacatgaatgagatcatgtcaaccttttgcataaatctacgacatcatccaattggctcaaaaccaaagtttggctaccaggtactaagcagtcaggttcctgtgatctcgttgaccccagtgtaccaagcactgtcctgtaccttgtgtccctcacattccctttattgtgttaggatttatacttgctgggttccctctatctagaatgttcttcttataagtagatgtttgatttctaccaaacccttctgcctttgctcaaaataacaactttcagcaaggctatctttaaaaacatcagattgtttttttatgaaagggttataaacaaacttttatttataatacacaaacagaaaagggcatttataataaatgtttaatttgttaaacattaatcatcatcacaacactcccatgtatccatggtacaaattaagaaatagaacattattggtaccataaaaatccttacttattttctaagtcagagaattggcatggtttctgaatcatctttggaaattttacattccacaatattaaactcctcttatctataaagtttgtatatcacctctttttttctttttggtactttggatctttttttttaagggttattttatgtatatgagtacctatttctctctctaaacacaccagaagagggaatctgatctcattaaagatggttgtgagtcaccactatgtggtttctgggaattgaactcaggaagagcagtcagtcagtgggccatctcttcaactctgtactttggctcttaacctaagaccttgtacatataggccatctgccatgcctgtgtggttttctttttcctttctttttccttccttccttccttccttccttccttccttccttccttccttccttccttcctttcttccctctttccctccttccctccttctccctctctctgtctctgtctctgtctctgtctctgtctctgtctctctctctctctctcttttgttgttgtctgtctatctgtctgtctgtctgtttttgagatagggtcttactatataatttaggttagtatagcctaaaactcatgatcttctgcttctactttctgagtgctaagattacaggatgtgccagcatccccaacaggacactatctattaaggggcaattgataattcaattgcttctctgggaaattgtaggacaatcaagaagaaactaagtctagaacattttctggggctctgctggcttcttagagagcagatatctcatgtctctctgttctctaggaaagatgtagatattcttctctccctagggtaataagatttccatgtggtaacatagtagaatttaatttaaaaaatttccatcactctggcccgtacaatccatacacacaggtctccttcattctcttggctttgtccatttgtcaactcttccaagatggtattttttcttgtttatttctcttttccttcattaaatggaggtactgggaagccagagctacttgcagggacctttgtaaatacatcttgaatgcattgatgtatgaatgtatggatgtatggatggatgaatgaatgaatgaatgaatgaatgaatggatttcagcttagcctagccagtctgtgttttagatagctgggtgtggggcccagactaacagggacttacaatttggtatgatttgggttctgaaatgtcttcctctgctactgtatgtggttcattggcccaattaaagagcttcctctcagcgtagaagcttgagatgcaaagctttctaatcttggcaaggcttgcaaagaagctgcttagatttggttagaaaccatcttgactgccagaaaatatagtcactgtgttgtttaaattcacaaatcaaaataaacaccctgaaattgcagtacatttactaaatctcagtatcccatttgggccaacaccatcatgtatccttttttcttttccttcctactttagtctctctagatcagaggcctcgccacaagatgttgccccctccagcatcaccatctctgcccacgatctctcatacccaacttaaagttgaatagcttccatgcaaactatttcaagtaaagagagaaggaagccatgagctattaacagggattccattcccctatggccttggtaatttctagaacattgaattaaagagttctcagacctttacaaattctcaaggcaaacattattagcaaagagaaggccgtgcagcatgtaagaagattgccagaaaatgtcactggaacttctgaataaaatcaagaagattcagctcgctctccatcttcctctaccccctccctctaacacgattagaaagttatttcatgtgtcttatgtgctcggtcagtcaaaggcaaacctacatgattgatggtgacagggaacacatttaactcattactctttactttgcagcaaaatgatttgtgtaaactgtctgcctagcattaaaggtaaaacaaacttagaaaccccaaaatgttatattttcatctaatattttccttttggttttatagctgtaatcgcatatggattcttttatttagctcttggcatcgacggaacaaaggggaaggcagggcagaaagattacataacacacactgagtccatgctcagagagtgtggagccacaaaagccacaacagtcaagacttaatgtgacaacccaggagaaactgtggctctctctggcccctatcatctgccaggatgttgtcactgatatgaaatgaagactgtctccttgatcaagcctgttgatattaaactgggccttttcagaaactattaacagattgcatatgttcctatgtgcacctagacaccacaggcttcacctggcttccatgttcttccagctgcctcctcctctcctcctcttcctgttctttctcctcctcctccttccacatcactgtaataattcaagcaagaaacacagaatataacttcagattcacttaactctgctgcttagtagtacagccataccatgcaaagcagtgaggaagagtttcaaactttccggcaactactctgcttgcaggagtacagacccaggagttgccattgaatcaatatgatgggtattttgtcttggactttagattatgtgaatccgctcagttttcatagcccttttggggttgtaagttttacatttttttctttaattatctattttctttcttttttggtttttaaatatgtttgtgtgtgcatctgatggtctgtgtttttaactacatgcatacagtgcctgcagaggctagttagacaaaggagggtattagatctcctggagttggccttacaagtagttgtgaacttcccaatatgggtgctagaaatggccctttgcaagagcatcgagtgcttttaaactctgagcaagccatccctctaggcaaggcaaacatttttattgaaattaatttttatttgaccagagaataagtatgctttttttaatgcacctggaaattttcataagggcaaagaagctacgatctctgaccaaaacaaaatgaatggcatctgtcattctttgagagcaagaagttactaaagattcttattttggcctgtccaggtggttggggattggtagagccagtttaccacacgatgctagctcatggctctatctactggtatatactgctttctcaacttcaaacacttcaaactttcatatacattgatatcaatagcttctaaaaacagaacctactttgtaatctttgcaaaggtagtaccctagattttctatcaacttggtcaaagtattgcagtataaaaactgaaatagttttccaagccagagagacagtatagcatttaagagaacatgctgctcttacagaggacgtggattcagtttctagcacctatatgaggcagctcagaacttgtctgtacctccagtatcagggtatcagataccctctgtgggcactacacttggatgtgtatgtacaggctggcatgcatgcacccacacacatacacacataaatacaacttcaaaataaggtaggaaactcctgttcttcccccttttctatgtgatccttagtgtgaaaatgacccaggaatgtatgttttctgagattatgacaccttctcatatcaaatgattttctgcttaagtcaagtgctttaaccaaatacagaaggagtttggtaatatgcttttttagagggtgaggtgaaaggaagattaaatagcccagtcttgaccatctaaagggagggtgagggcatcagagtgcagtagaggaggtttccagcacattgaagatgtcagagaaggggaagccagagccagagggctaagtagtgtaacaaaagcaaaaagagtattttctagaagaaaatatacatccaaccttaatcctctccaacctcttgtgatcatagaaaaaatgaattcaagtgactcaaacaatttgcggtgtagagggtaaagctgtgaaataaataaaaatctgcttgctaaatccagcatttctctggctgttcttaatccttaagttgtggtcccaggaaggttcaagaatgactgttcccatccacatccagtgccacatattttaacacatacgcgtagggccatatatcacctcactatagaataaagaatagtttccaagccctacattccctctaagccctctgagggtctgggctccattctctttcactatagttccatgttttctggtgagtcttatggaactactagcaataagcttcttttctttcagagtcttttttttttttttttttttgtaaagctccccctatgttgttgcagatatcaagactccattccttctgactactggatgatatggcatttttatggctgtaccaaaatttgttcatcagttcattcatgaaacaggcacagcaattagctgcttctagtttcttgagtgtggtggtgggaggggtcaataaaagttgtaataaatatgtgtatggaagcttgtgtgaataaatacatagaagtaggattgctgttttataaggacaaatttctgtttaactgtaaaagaaactgccaaaccattactctgagtgcctatacaatttatatcccctcaaactgtgagcccaagtcaatgtcttcttttaaaagttgtcttagccaggatttttgtcccagccatgagaaaactaatacagatacggactcagcctactatagtttgggccatggttcatttaaaagtgtgttgcttcatttccactgtggagtcagaagagcccgcccacattttttccagattttcgaatatttgtataggcatactgagctatcttggtggtaagattcaaaccacaccacggaattcacttacattcactatgtattttacacatatgccccaaaggcatacagttctcaaaggattctgcacatgaaagagtttcagggaggaaggttttctttttttttttccttgggatgtcatgtcagtggtacaaatttttcagaatttggagcacgttggagttctttggactaggggtacttaatctgggaacatttctactattgatggacttactgcttcctgaggaaatttcatctccatttattcttgttaattttgttttgaagactacttcagatatttgtttctataggttctaaaccttttatttgcagtgttttgttaagaaaatgtctaccccctctgctgaagtattcccttacccctcaaatgcatagctgttcccttttggtctcatttgaatgcaacgatgtcattaaattctaagttatttccttttataccctcccataggtaggtcagttttaaaagtctactctatgaatttttgttaatccatgggttgtattaatctgttttattatgacttagaaaaatcaatttatttggatttgttctcactattttattgattgcattatgattgattactgtgtcttcatgttcttctctactcttttatttgaggttatttggacactgtcttgaaagttatttcattaattgattggttaatgcagtttataaacgtgaggctgtatacccactttcaatatttgtgcacataaacattacccatcttatgtcttcattatatagatgagccctgcaattattagtgtctgcttttattctagaatattagtgctgtattttatctgtggtgtttctctagctaacctaggctattaacatttacctagtcacatgtaatataaaagctttatcagtctgaccccttatgatctcctaaagggagaaagaaagatggtgctgtactgtgctacatgttacatacttggtgatgttatatggtcaaatgcagccgtttgtattcatgccaatgcttatgctctgtgtttctgaattctgctggtggcccgactctcctgttatttctgtcctgccagctttgacagtgagttcccttggagcctttcctggaagccagcactgtcctccttggcctgagaggggattaggtcagcctcattctggacaacattttttgtggagatagaattctgggataacagttcttctcttctaaccttttaaaaacccgttcttgctttctttgtcatgagaaaaccctttctcctctgaatccatgttagcaccttcaggtagctttctctggatcccattaggggagggggtctgcttcttttctccaggtttctgttgtctttctaaggagcttgggttggcattgttcttctgggtccatcctgctggagtttactgcgacagctgaaatgttagctttgtcttttggtgaaactgggttttagttgtgttctttcctgtaccaccccaccactctgttctcctaggatacccaggccatgaatgaggaatcttttgttttctttctttttttcttttcctcttttttcttttcttttccttttttttcttttccttttattccttcttcctttctttcttccataagactcaaactttctagatgaattttttaaatgccttttttttctgtttgaattttttatatactttttctattgcccaaatcacacagtttaagtttttagtatttaaattaattgattctttcctctatcttcattctgttgaatctatttaatatttagtgacaatgtttttcaattctaaattttccatttgattctttattaacatttatttgtttgcttgttcatttattcattcattaatgtgtgtgcatgcacatctgtgaatgcaagcaaagatccagacatgactggatcttttaaagtcttagcgtctagttgaggttgatttaggctgctcatgcttcctagacttctttgcattgtgaattccagtttttctctttaaagtcttagatattctgtttgaattagtcctgtatcagcctcaggctgaatgatggtttaattctcaaagtcagtatccgctgtgaagagtaggttcttcctagacacaaggtagggtgaacctgggagttcataaattgttctatgaggctgttttctcaagatccttctctttgatctctgcaatggtatttgattccatcagtcctttcttgatgctctagccaggaaaaaatgaaattttttggatatttcactttgttgtagactttctacatccatggctgtatttggggttgcctagtagaaagagagagacaaaaagcaacagggcttgacattctctttcctgggaccaaggtcccatgacagactctcctacctcctttaaccttcttctggttcacattgtcacacctgctactgttccctttgggtgtcctgggctcaggacagaaaaagaagtagctggaaagaatgaacaaaccattctcatttaccccattcttttcaagtataaatcattcccttttctgttcccagagccagcatgaatacttctagagctttctctgtccacagtattgtagctactttcagatatcgaattgacttgagatcagactagaggctatcaggggaagcaatggcaaatgcactgttggttttgtgatttttctaaaacaaagagaacattgcctcttttgcattgccatcaatactacctattgtagtgtgacaataatcattctctttggaggaacccttttacttatccacctttggctagaggctgggaatatcaaagcttgataagcttgggaggagccaggcagtggtggcgcacgcctttaatcccagtgcttgggaggcagagacaggtggatttctgagttcaaggccagcctggtctacagagtgagttccaggatagccagagttatatatagaaaccctgcctggggagggggggtgcttgggagggtatgttccatagctaattcctgttgtatcatctgcttccttgtcagctatgcagtgaacttctccatagtatgtttcttccactattgagtcctatctgtacacacagaaccaagcaaataagggttgaaccccagaaaccataagccaaacctctcttagtttgtttctattgggtatttggttacagtgatggggggggggcagcatgcagagtgactactaagacctccctcttatttagcagattcagtgggcacagaggcatggtccttctcaaagaggtaaaaccaacctgtctataaggatatggaaaaaaataaaaagtagtatttctaactcaagcaattaattccatccacttcctatctcctattgtatacagacttcagtcctcatgataggacaacagtatctctgtgaacttgaaacaccaaccaaggggattgcattgctcatgttgtcatgaaatatatgtggtagttaatggtaaaaactacaaacaaacaaacaaacaaacaattccccagttgaaagattttatggagtgtcatttttcaagatgctgtatggatacttaaattgacctcaacacctttttactgatgtctcaacatttctcgtactcatccaaatgggtttgcagttaaaatagccatctcacagggttctaccaggaactatcttgttgacacttgtccagaagaagcttgtcaagttttgatgtctatagccaatggcaaagcatggatgaattcaagggttcctccaaaagaatgattattgacatgctagatggtaatgcaaagaggcaaagttctctttgttttacatgtgcagggcaagcaagaacagttcgtaaagagccaggcgagttcctagttttgggtgaaatctagggaacacagtgtacctgaactaaatgtgacaataagttctggacagaatgctttaagcagctatgtcaagactctgaacagcacataagagcaaggaggctaaggaataagactatagtaggaaataccaccaagccaatgatgtgtttaccatggcttccctggaatcctctgggctgatctgaaggcaattcaaaccctgagggtacagactaccactgacatacctcttcacagctcaatgttctgacaaccttccaaaacatcctcaacagcagggatctaggagttcattaacataagaccagggtgatatttcacaccatcaactggtactgtgcacaagtctgtgcgtattcttagcttccatgtttgttgcatttgtctttaggacaatgggtccactccttttcatttccttttgttttcatttccttaggggtttagtgcttttctctccttattcagataacatttatttgccaataagaaggccagttccattacatatgggtattttccttttccctatattagattagcaaggaaagacctaagcaaaggaagaggcttggtacctctttcagaatggaattaggtatccagcctaactgtgattgaaacggatcatccatgggtctcagtgcttatatatctgtttttctatgcatctatctatctatctatctatctatctatctatctatctatagatcaggttggtatccaagccatagcccactgccttcctatgaacttgtggagtgtgggccttttggatgttgtacactggtcaagcagataggcaaggtgggaaaggtggccagaccagtttaggatgtgatttttttcctgtgaggttttgagagccttgttctgtttctaatctttacctgcccagcaaaataaaaggagaagcttaaggttagtggaaaattaacaatacataaaaactcttaatgactggtccataaactctgtccttcttgggagcaggtagcggcaagccctgtttagacttgaccttgcaatgagactaaagattaaggttagtgttgagtcactgctgagagaagataacaaacaaaacctgatagctaactatgctgcaaggtagcatgaaacatctctacctataatgtttacaatcttatgttgccaccatttttgtagctgactggtattgagtgaggttccttaaactctttgtgggaagaaacagacttgaagaattttctgattgagtgcatcttctcagccagtagcatggctcatcagcctaaaaggttccagttcttcaaatcccttaacgtttctgtcagcccccaacctcctcaagggttcatgtgtattaatctgtgtattaatttggtaaaaacaaggcgtgtctgttggccttcctccaggtctctgaaccagtggagatttgctgagtgtcctttcctccatgttaataagaacctatccagcaggtgcagctgctgtatgttcagttcaacatacagggaaagtaggaatatgttggaatgagccacttccccaagagtcagagagataggtgtgatcgccaactccctaccccatcactggagtgcagtatccacttgaacttgctcatgagtccagtgagtcttggggataaaaccaacccttcttgccataaggatcatcatgagctctccctatcatctcatggaatgccaactgcaggaaggaggccagtatggcagttttctaggcatattaaactgtaacatgggctaaaaccctctagaaatgacacaaggggggagaaaaatatactcctcagaagtttcttaggaggcatatcatttgtggttagatggaagtaaactagggtgggagggttgagtcttctttctccaaggggcatgtagcaatagatatgttctcccttgctttctaggagtctcgagttggctaccctgcaaaccttagctgagaagagaaggcaaagcaagtccaatattgacttacctgaacaggagaggctgaagttgcaaaaccagagttggttttgaaatttcatttatttttaactttacgtagtatttagcctctcctcaaagtgcagccagtcatgcatttaataaaataatagtgtttgcagacgcaggctatagttaaagcgatgagtacctggttctaatccctagaatcaagtataaaaggaacctggaagctagagtgatggctcagcatttcagagcactgattgctcttccagaggacctgggttcaaaacccagcatctgcatgatggctcaaaactgtctgtaactccagtcctggaggtccaatgccctcttctagctttcttgggcactgcacactcacagtacaaagacatatttgcaggcagtatatatgtggaaggagtgggtgtgggggtaggcacatgctagcacatgttttgcaaccacatctctgggggaagtggagacattggggcttggtggccagccagtctagatgcttggtgagatccaagccaatgagagaccatgtctcaaaaaaaatgtaggtagcatctgagtaacaatgtccaaggttatccccttgtgtatacatgcatgtacacacatttatgagtacctaccaacctatctacatacaagcatacatacatacatacatacatacatacatacatgtgcaacatacatacacagggacatacccatacccacagtgtttgggaatttgctgatttattagcattccagtcatgtgaggtgaagagttgctgggtttcagttcaacatgagtccaggaaaaaaagctagatgtaaaggttaaggcctctgtatagagaaatgagagacaaaaatggagcagaggaagcacctattgagaataagggcaagcatcataactaagcccagattcattctatttcattctggccatcaaggacttgttaggtccaggtttcctttggacgcctaggttggccttccctagttaatgttcatagcagagaaggctaggttaggccatcttcatcatcttagtaggactgtgcacacactgtctcctgttttgggagactttcatctttttctaactcccttttcaacatcatttgtgctcagggtgattaggaacatctatggagaattggaagtacctctgcagagttctaatgtgtttctctttaatccagagtcaatgatcagtgctattccagccattcctagcagcagctaagtaatggaaagttatgaatcataggcccagcatctcactggcttacattcatttgaacactagaaacatcttcataatcctatcactaccagtatcactgtcattactattactcatcacccgcagtggccactgacatttatagaacatctataaagtgacactcaataaatgacacagtatgactattccacatgcatttgccaggccctgtggttctatatgtatcacctcgtttgaactatcttcatagaagcaagcattagtgctacctcatttttcaggtaagcaaggttatgctgtttggctgagggtcaacgaggctgggattcaaagccagcgttttcccaggcttagctacgtcctgcttctattactccaaccagtgggtactcagaattgtggctatcctgctcccaaaagaaaattgctaagcctagctaaatatctcagtaatttgtataatgccacttccactctctgaatcagatggctttgtgatgtggctggaaacccgctctaggaagctgcatagtagtcacttctaacttcctgtgaaaatattctctaactggcaagagattgtccagataacaatgcgtatacaataaaccagcaactctgcctttgatacctggctcacaaataacccatttggcttcccaatcaccctgatgcctaaaaccagctcaatttatgcttgaggcagcaatggctctgttcagccagaaagcaaaactttacgaccaaaccctttgctctgaaatgaaatctagtctctttggctcgactttattaggccatattgtacagcgataggagacataagtatccagaatctgctgtcactaaaatgggactgggttggcaagcatcttcgtcctcacagtcaacactgtgtcctaaaatgggaaagttgaatagaaattagggatgcaaatcagggccattttctgaaactttatttttaattgaattaaatatagacatctatattgctattgaatctgtgcagcaaatacagatggagactgagctattagtgaggtcatcggatcaatggccagagactaactagatgaatctggaccctggaaatagtgtttagactaattaccacaacaacaacccaaacacttggaggcccatcttgtgcctgattatgtacaagcttcctccataactgcctccaattgtactttatggccataatttttcctgtctttaactcagaccctttaggctgccatgggatttctctaatccctagttcacaaaggcatagagattcctggttccttgttcttcactgcctatgggaataacactttgccatttaacgtgtggtctttatgttttagcatcgtccaggagtttccctcagggctgtggcatttgtagctacattctatcaagtctccttgagcaatactcatgcatatcaaagtttaggaggtactggacttggtgggaggttatctttgaggctatttgaaataaaatagcaggtgtacccattgctaagaaattgttgttaatggcagtggactttcatcaatgtgtctaaattactaaaagatttctcaaagatctaggcagcacattaaatttctgtgtcaccaaaagcaagcttacaggattggggaaatttctcattcaatagagtgatttacacataagcatgaagacctaagttgtaatttccagcactcatgttaaataaatagctacacaaacataaatacagtcaggtatggccatgagcacttgtaatctcagtgatgaaggtgtgaatataagatccttggagctcactggccagtcagcctagctaaattgatgagtaccaggctcagggagagatcttgactcaaaaaatagggtggagactgacatagagaatacacatgttaccaacagtctctgagctccacatgcacagcacacaccatgcctatctgcaggtgtacaggcacatgtgcaccaatagcatgtagataacatacaaacacacagaagtaagaccataattccaattcaagtgttctagctaactcctccttcgacaagtcattgttgttttaaagatacaaggaggggagagcacactcgttttcagaacttaggagtaatgatattgccaaataaagtttcctctaggcttggtctgtgctattgattactgcttgagttgaccttgcaatctgaacatcgagaaggtaaagaggaggatagtcccctaggactgggcaaggagaccaggacttccctccaaagggatgacgtgggacgcagaaggatggagagttaaagcacctgttcttgagcctgccttctctcaacccaagcctctaaactactctatcttaggatttagaaaaccataagttacctgttgtacaatgttgtacaatgacaacattccccagaaaataattgctcatggtaagaagtttcctgggaagtttcacaattacctccttgctagagcccaagactgtaggtttttttttttttttttttttttcagcatcaagagaccaaaagttggttcatttcatgttccaacactaaacgatacaaagttatccatgctcacttatgcttagatgcctggaaaaattgtgcctgctgctctctgtctctgtctctgcttttctcaggcttacatcaactcagcacatgctgaccgagcacttccaagttgcagactagcatgctgcttgtcctactaataaaaggcagggttaatgagacagtcttttccccatggaaggagctggctaacaagggagagctttgtgctcctattacatttcatggctgttcaggtcagatatctgatggatcacatgatctgagagtaaatgatgccagctagtatagctttagtacctgctatgtgccagataccaccctatgcattggatatagactgtctagtacttgtggcttgcttggacatggtaagtgaatatccatgaaagcaggtaaaatgcattagaccatggacgtgtaagaaatcaggtagcattaaattcaaagggaaaggtagaagactggtgatgaaaaatagctgtggagagatgtgtagttctaatagaagactgaaggaatcagtcatgccagggtgggaagctgagctaagaagcatttagcttagcatttcccatctccatggcctactctgtgaatcagagggtcctatgactgtaggtaacatctctccctttgagatttatagttcacattagtagttaaatatgctaagaaacattttgctaaaaccacaaaagtttgaaatttaattaaaaagttattttgtattattaaatccagcactccacatttttttaatccactcaaaaatatcaccatactctaactacacacaatgcccagttccaggtagtaaagactcagaatataaagactcatcaaaagtgcctacattcttgttgggtatagcataaaattttctcaccgttcaccttagtttcaggtaacaccttgtaggaagttctgtccagttcaccttgtaatctatctcagctgaaggtaatgctccttcattttgaaacctgagggaagttgtgtgtggtacctaaagatcctaagataggagagggaaatgttataggcaatggagtttcagacacagcccacagtccatggacaagtgctgtgagatgtttgcagctcactcggcaggagagaagacacagaaaatgaaatgagaatctggaaactttttgagggatggattttatgttagttggacccagtgacttaagattttggccccatgcttgcttcgttttaccttctcatttctttcctattgtaattcacttttactcaaaatttcaaacatttgggtctaaaaaaaataacatgtcagaaataaaacaaagccctgcttccttccagtcaaatgtgttgagaatggctccttggaaaattctaggtttccaggcctaactggggttaattggggttaaggctggggatggtggggtgggggaggcagcaattcctgggaatgtttacttcctgctccgctaccccagttagagggattttaggtgctattttaagaatattatcatttggagcagaagtgaagatgctatgaactgttagcaagaatgtaaaaccaaattcctacttgggcagatggtgaataggccaacttttaaaacagttttacatgtcttaaacaaaagtaccttttctatattggagaggaatacaagagagaaggaaaaccctacttaccaggaacggtaccagcatcctatcacagagataatagtatcttaaataatttcttcatagttattgttttgaaaaagttctatgtcgccatttctgttaaacattcttttacttcaaaccctttgacacttcatgctgcttcagaaacagtctgtgctgaggtgagaaaatagggggaaacaacatgtattgaaatgcatttgtgtgtggtgtggtctgttcagttttctctgaatatcttatatgggctgattacttttctccataatgattaacaacaacaaaaatatcaaaaaccttactttatctgggaataaaaaataatctggcctaaatcttcctcaaattaatctttggggttgtatatatttactcatttgaggtcaaagcaactacttacctggcattccatcaaatctcaaatatgtgttttaatttgcttccttcagcctttggaaaaaacctgagatttttttcattctgtctcctcattctgaaaatcatgccctgaaataaaccatgaaaatggaatgccaaattgtgataaagaccctgaaatccagcatcacttccagaaagcctgctgaccctatcaccatccaaggagtatggcactgataggacatctgaccagaaaggaagaacattccagaaagacaaatgttgggaattggttttaatgctttgtattattttgggtcccaaaagccacgtttcgagacctgagggtctctgctccagcctggcttagattgataataaagacttgctgttcagccattggctgggcagggagaaaggtcgggactttgagattgctcgggtaaggaacaaagagggcaggggctggggaagaagagaattgccatgacttggagggagaaggatcatatttaagagctgtaggagagaaagcttcctacaatgtaggtggaaagggaaagtggccatatagaagtgggaagggctgcctagaagataacagggcagcaaagataaaatatagatttagaaggtgttaagccaggaataccagagggaaatgtgtgctagccacagtgaggtttagaaatgcccaatcattgagctaatcaaggcatatcaaaattagctgacctgtgtttgtgttttatttgtgactccagagaacttttgggtgggtgcagtgcacatatgtgttttaactaattcgccacaacaggcaaatcatcgtttgcctctgcttcaccccccccccccccccgggctctcacttttcctcctgcttatttaccctacaaagctgcacaggcagccattttgtgagtcggcaccctgtggtcctaagcactattctctcatttggctttttaattctgtgagttgctttaaggatctgtaattgtgctggagcaagaatggtgtagatgaaatatccacatgtccctttgatcaacactgggatatgttcatgggctatgaacacagagggaaacagaggagaggagaatggaactctagtgatggggtcctgttaacatgacaacattgttgttttcagttagaattgagagcatacagaactccatcaagcattccccagggacagcactctgttgaggaatgagtataaatgactccactcattttagtaataactccacacgcaagttagccaagagcccataaattctgatttcatgtttattgttgtaataaaatgtttgacatgttctgtgggtgctatttcttttatgtcaggataaatatgtttttaggggatctaagatagtgttggtcagttcatgtcactacgttgttgtagaataccacactgtaaaatgacagggatagcatactatgtaatttctgtgtgcaagtatttatttatatgtaaataacttttttggatatatatttctatggtataaaatgacattttgccagggaaggagtattcactgagaattcagatagactttggcaaagaataagtagagacttagttcaccacccctaccaccccgtgggggccaatattagtgtgtagatgttacagcttatcccatcttattgcagcaatgaggataataagcatcagtctctatgattctttttcggttctttatttttaggtatataaaatagcatctatttgaattaatgcagtacacttacatccaattaaataaggatgggtgtttgataaccttcagggtcatttgtatggctcctgaagtagggatggagtttttgcaaaatcatttggctctaatctactcagttattcactggcaatagaaatcactatggctgttacaaacccagccaggagggctgaattgttcacattcaccaggctgttagcattagagaaacacagttttctttctaatcaggggaagcacaaaaaataaaagctgtcgttctcagcctatcattagtaacacatgcaaaacctgggatcaggaaggagtgagtttgcagagagccaaggctcatgactatggatggaaggtacattgatggcaaggctgtctgcccatgggttggtgtaaaaccatttgcttgggaggttcaactagactggttgaaaaattagatcgtgaagggtagataaataaaaccataagaggtgtagacaagctagcctagtggctcattctcttttctcaccgaaggttctgtgcatgtttgatgaataagtacccacagcacatcacctgctcatcttgctaggagctcttgtgagacacctggcatttgatgtgacagccaggggataaattgctgcctcaggaaaagctttgcctttgactgattgctgaatggttggaaaattaattttggcacctttccttaagtcattttggtcctattccttcatttttctgctgggaaatgtgtcttcacattacagttaaaaaatacattgacaatacaaatgtggggcacagcatgtactatttatggaaagaagttgtaggctgggacagtgctacttcatataatagaaaggatgagttttgctctgcactccccttgcagctgagctcaatatcagtggctctccttgctggctactcacactaaggagttcactgctgatctcctgagtctttgatgaaggactagtttgctgttcccgcactgagcacttgtatataacaaaccctctctgtccatatacaacctctctgggcacctaccacgttatcactgagcaagagatacttgtgttgggcagttaagggcatgaactctaaataatgtttgtgcaactcactgtctttgtgactgactttaactaggtgtgtctcaggatgacaaaggatgcctcaactctctccaaattgctttatgctctctctctctctctctctgtgtgtgtgtgtgtgttaaaattcaacacctattttacattaacatctcttcttttgtggtggttccactgacaaaggtaagagggatgtgaattttcattcacatgccttgttcacatacttaacttaggaaaccaaaccatgataaaatgtcaagatctaagccctgatacaggtcaggaagagtgaatttccatttccctagattgcggtatggtccaatgtcatagcataatgtagtcagatattagcagaactgtatgtcacggagaccagctggactcttccaccttactcagcagcttagaaaaccagaaattgtaactttaattattgattcaaggaatatggtctgagtttgggatgtagcacagttggtcgagtgcttacacagtagtgttccatcttcagcacccatagcccaataaactgggtatgatgatacattcctatcatcctagcacttgggaggtagaggaaggaaggtcagaagtttaagttcaaggtcatccttagtttcatagcaaactcaagatagtttggagctctttaagaccagtctcaaattgtaacaaatgggatctaagtttgattttggggtgccttctgacatgatgttctcacctgccatcaagtcagaggaggcattctggtaaaagacaaggctgcatacttactatgcattctgtacaagttaacccacatggtcctgccaatcacatgagcagaagaaagctctttagaaacagcatgtagccttcctaagatgcagatgaacacaatggttcccttggtctttattagcccttggcttttgagggtgctctctaatatctacttgttctttgcatagcacccagttgtctcctctgaattctttaaatggagatttcaaggccagaggagtcaaggagaggcaagaatgagatcctgatgccaaacagtgctggttcctaaccctggctcttgtgataggattcccttcttcatgttctttctttagcatggtttgacatcatcgtgtttaggacaattagcatcatttataatcagaagcacataactcattggcatgaagtacatttacatggctatgtaactgataccaccacccatcttcagaattcttctcatcttgaaaaattgactcgttgtgccataaaagcaatgactttccctaacctcaccagtgccctttgcaccatccacttccgtgaatttcagacatgaatctcaagtaactgggcccccccaccaatctttgtcttttgtgactgtggtctgttttagcatatgtggtgaaggtttatccatagtgtagtatgtgccagaacttcctttcttgagaaggctaaccagcatgcctttgtgggtctgcacatccttctatagacactttggtattttcagacctaataatgctattctgaccccttctcattttctctagttatgtattcaggactggaattgctgcttgtataagcaatcatatttggaatccaagaactgtttcactgtttcccatagtggctgtactagtttacattcctactaaatgtatgtctttttggaaagatattagtataattaaattagcagttttatagtgtgtgagtatatatatatgtgtgcctatgtgtgtaatgccttgattagaaatcttaaaaaacattgtaggctgtgcatgtgcaaatcactccaaagatatgaaagtcttaaatagtcaggacaatgaattttaaactccttacaatttgtacagttgatttgatgctattgtgttcagcattgtagacaccatctgagaatttacatacagatatggaagagggattcttgttttatagaatgttttgaacgtttttctcagttgtttggctttcagtccacaaacactgcacatttgccacagagacaaacctttggggaaagaggcaaggagaatcaatgagagacagatgcatctagtaggatggctgcttatatcctagccaggaaacatatcaggaagaatgtgggaaaataaacacaagtttaaaattagatctagtcagcctctagaataagtcttaaaatatagaacatattcagtaaatatttactgagagaataaatcaatgaaatatttttgctaagtttaacaaaagcataacaatattattattatataaagaaactgtttctatttacttaccaaatttactgactaactgttaattcattattcacagaagcatccaaccaattttaataattaagcgatcaatatgaaacccatattatttggacattaccagtaatgttaagataaagtttatattgtcagtatgtttggaaatcacttgtaatatttaaattagaaaaaaatgtctgttatattaatagagagctgtacaagcacaagccagacaaagtcccagcatgaagacaggaggtgggcacaaagatgcatccctagctaaggggatattgacaattaatagctgttggaagagggaatatcagttttcattaatgtatggctacctgatagttcaactaccaggtgcaggtactaccaggtgaaaatcctggtaggtcaatcatcctccagtagatgaacacacatccaagaatatatgggccacacaaatgggacttgatgagttttaaaaaagaaaaaaaaaaagaagaaacaaaggtaggaagggggggggtagatctggtaagacttgtagaaggggcttgactatggtaaaattatattacatgaaattctccaagaactgataaaatgtattaaataacaaaaaatgctttaacaaaaaaaatgtttctttaaaaaaaataggtagaactcttatacctttaggtaaactattttttccacaaagctctgcgtagctaacacctgacatacagaggcagacagaagcagctccttccaaggagggtaacttatgatctcaggctgagcatgaagcccatgagggagggggcatcccattcacttcctgagtttttattctggatttgatggcctgagtataaccacatggttgaagcctctgctctttctcaggctccccacatctcctccacacccggatgtttcagttctctcagttaactgagggatcagtcatggtcaggattcctcacagcataagaagagaacaacaaactgttaagagctacttcctgtggctagaacagcttcctgttgtcatcttattacttaagccatcacaggaagtgaagcctgggaagctatagggcagagccagccaaggcggtcacagactcctcaatgcagagtgattcaggcttgttgtctaatttaagagtttccaaagattgagtgcaatgaaatcactgcttggagacagttattgggaaacccagatagaccttattatttagaaaaaaataaaaacatgctttttaatgaagttttgggcatgactcctttgaaactatattttgcttattgtgatattcttagtagggtgagaaaaaaaatgtttccccaaagtaggaatatgtagattaaatgtaatacatagtgtgtgggcatgtgtgcgtgcacatgtgcatgcatgtgtgtaaaagtcttcagacaatacattatctattttaaaaactagtatcctgccactcaaaaatagttgctactgatctgctataaatacttctagactttttcatacagccctataaatataaaagcagatataacttttaaaaataaaatcacctcggggcagacgaccatgcagttaagagcacttgctgcctttctatacaacttgagttcagttctcagtacccacactgtctggctccagcagatctgataccttcttctggcctccattggtacccatgtccatgtggcattcacgccctctcacatacatatacagaaaaaaccaaactaataaacaaataaaacagataaaaatgtcattataatctctcattgattctaaaatttcacatgacctgtgcttatttatgatatatcatgaatcaaaaacgtatgtttatgtgcttatgatgtagaaacaagtttcaagagtggcacaaacctacaactccatctttagcttacctgttaaaataatttgtttccttacaatagatatgtgaaaatgggaaacctgcataaaagagtatatggttctatgaattttgaaaatgcctgcaaaattgttctccagaaatttgtatcagttaacacaaatttgttcattgtagatgggttccccatacccttagccttagaaatcatgcagggtcacagcaaagcaaggacttagagacctctcttggtcattaaaagtgtttgctacacaatcttgaggacaagaatttggatctaaggctcacaaaaggtgtgtagtcttcaaatgcctataactccagcactgcagtatccaataccatcttctacacaaagaccaatgtacacacatgcctttactctcacacagacacagacagaaagacacacatagtcacacatacacaagcacatgcacataaacaatcaaacatatgcatatacacacatgtccatactctcacacagacacagacaaagacatagacacacatacacacatgcccatactctcacacagacacagacagagacatagacacacatacacacatgcccatactctcacacagacacacagagaaagtcacacacagtcacacatacacacaaacacacacatacacaaacaaaacaaacatacacatatagacacatgtccatattctcacacagacagagacagaaggacacacacatacccatatatactatgtatatactctcacatagacagatacacacacagtcacacacacacacacatatccaatctctcacccagatgcagacacacataaacacagtctcacacacacacatacacatatccatattctcacaaagacacagaaagaaacacagtctctctctctctctctctctctctctctctctctcacacacacacacacacacacacagagtcacacacagagccacacacatgtaattaattttttttaaagcaatgcagtgttttgagggaaatctacctgaattcaattatttttggggtccctgggagcttccggtgggtgctgtggagatgtcgccagctgctgaggttgtcaccaggaaggtcattgtgtcactattgcatttgtctctttaactaagactgtaactggagccccccctctgtcagagcttgtctatactttaaaccctcttcctgtgcacttttctcttagattgaggaagacacatggcagaaatactacttggaaggagtctccaatgaaatgtacacagaatatctctccagtgccttcgtgggtctgtccttccctactgtttgtgagtaagtgaccattcactggatattaatttgcacctcccacctctgcgcacactggtcaggacacttgacactcgttcaggggtccttgtgggttcagtcctgcatgtctgtgaacaacaatgcatgttctgataaggttcctgcctttgggttttgtgctggatccagttcatcccctaggtctgaaaatcttgatgtgaaatctgatttatacaaacttacaatgtgtgcaatttgcctgcacatcttaagtaacgcctttgaaaggtggcacaaactcatgtggccctggttttgctttgtttcatttcatctatatctgtctgtctgtggtactaggcattgaacccagggcctcacactcaatccctatctatctgcctttaatagagaaataaagcaaatcttgtcagttccaggataaatgaattttatcctctaataaagtccttctaatcaagtctgtagacatttaaagcactttggctatttactgaggaactatgctctcaagtgcgcaggaggaggcctggaaaaggtctttttcagcacgtctgtactcaaatagtaagaacctgaaatggtccccagggcacctgcagcaggacataccccgtagccctggaagaacaagcatcctggtccccagtgttctaggtgcccaccttgaggcatgatgggaccccagatttaccacttagcatctctggattgaagtaaaatcaaaaaaggaacaaggtgtgtgttccccatgaaaacagaaactctgaaagtggtggacctctaagcctgacccactaggacctgaccccttagcaaaagtcaataaatgctctcagtgataaaagctggcaagaaacagatggatctgagctgcaggagaagagccacagctttaagccggcaatttaccagccaagcctaccctctgggattctagaatgggaagtctaaaagtgctaaatcaaacctgagagcccttcatagtaaaggaaagttaggggctttgggactcttgttctgttctctatgcagaagggagggatggagattcctgtcagagaacacagcaggtgttctctgccaatccctgagcccaaacccccaagcactccaaaatggtttggttgtttacagaaatttctcaccctgtctctaagcgatagtttaaatgctaaatggactggaaaagtgagcaggtaattgattctctttcggaaggagcgcttttgtggaaatggaagccctactgtaactcccctgagcaccctccctgggaatgacttcccttcctgccacagggtgaagttaagcttctggagatgctgggaggctgccctcctttgtaactcagcctgcttccaatgggaagtctggagaagtcagagcttccaatgaaaacagaagaagctggctttttaagaaggctcttgaagtcctctatggtcaagacaggggtggtctgaccatcagggccaaattggcagcacccagagcgggggccctataatgtcagggatttgagctgggaagtttcaaagctctcttagccattaattttcctaattttttttttttttttgaaacagggtttctctgtatagccctggctgtcctggaactcactttgtagaccaggctagcctcgaactcagaaatctgcctgcctctgcctcccaagtgctgggatcaaaggcgtgcgtcaccacagctgatttaactagtatggagcctgacaggaaagctccagtgaagtcacttccagcctttccactttctctcttcctttactcctggggagaggggatggaagtctttttttttttttttttttttttttctttaactagaggcaaggacttcagcccctatactaatggtgcactgaacctgtggatttggcatggtttcatttgttcaaggctagttaccagtatttctgaaccataaaaacaacaaaccaaaccaaaacctgagtactttctttaaaatccgagttggccacagagtccatgtttctgcacaataccaacgggctcccacttgttttagtgaaagggctggatatgctttctcataaacaaggatggagtgacctgagctacccaggtcaaccccatctgcttgcagccttgggcgtctccactagccttctatgactacttgggagtctgcagtcatgcagaggctgtgtagcccagttccagcttctaggaggagcagttctcaccgttagtcgtcagaagagttgactttttccaggtgtggggaggaagaggaaggtaggaagctaaaagctccaaggcagcttccttgggagcacgagagtcaggcataacaccagtaagatatgaattatttcccttgatcgatactcatctttagagtgtgttctaatgagggaaaagctattttagacctaccttgttgtcagagaatttagtatttgttcagtaaagtgtcgggatgggaagaaaaaaaaaaaaaacagcttccgatgtgagtgagaatgtgttcggcttagtgctattattcctgtaatgcagcaattcggcagaggtggaagtgatcaataaagaaaggacatttaatgagatttaggaacaacccaaaacattgaagctctcttcaagcatttgattatcttgaggcttaattatctgtgttttctactttaaattaaagaaaagccataactcaaagttaccagcagtttaatgataacactcttcaattcgggttaattaaagcgcagccgtaattagagtgtagtgttgtatatcaccaggctgccgcgtaagtattttcattactgtaagaattggctattcaatttcaagatgacataaaggacgcccaaatatattttaagccggtttgtggagacggaaaagaatcggggaatattccgggtataataaagcacagataaaatatacagattttcagagtggtttccataattatgtaccacactaaaacaatatgcaaccaatgatgttgcaaagcatggaaagaaataaatttcctcttcccctaggctggcagcatgccacctagcaggtggtattggtgctcaagagaacccggagttttctcaaaagctagatagagtcgtcctacaaaaggagaaggggccggtagcaggtgaaattgaaggtcgtctctgaagaaaacagaaagggtggggacagtgcaggggaggcagaggcccccaaaactcacttcttcaaaatttcaagctgaggggtctccagggtgcaggattagatcccagacacagtggcagccctttgattctaccttatgtgtgaccaaaaggcaggacatcgatcccaagccagatgctcatttagacaaaatgcacgatcttacctaacctacccctgcattgtctcaaacaatgaagtgaggtttattctgaaagggctaggggtgtcagagtaatataaacacctcacgttgtacacaagaggtcccttagcttcaaacatggagactcagatgacctctggacacctttccaaaaccacttggaaaacaaaggacagaacaacagaaccagggttttgaggctcctccagtctcgtgcaactaggaacaggttagagtaggtgacagtcgaaggctggctcattaatgctttcctgggaaacttataaaatgatatccacacttcagctccagatgttaaaatctggagtaaggctttaaagtgcgcactaatgatttatttttaaatgaacaagtgaggtgacccttagctgaaatctgaggatgggaagctgctccgtcctccccacaccccaccccatcccaccctctgtcctgcagcctctgcagcctgctttgagccccagtacttaggcaaatcagagaatcacgggtggatttgcgtcttgcaagcttatgttaagatgtgggcctttgggagctagagagctaggctgagggtgcttgctgctcttgcagaaggtcagagttcagttctcagtgctctctctagcagctcacaaccacctgtaagtccagcacctgggggtcaactgccctcttcttcttggtgggtttctatatactagcaaaaacgtaagtttgaaaaaaagatcagagcttttgcatcaacttcctcttcagcatcacctttgagatctaaaataccaacaaccacctgcttctcccctccttttccagcaagggcgtgtaaaaatgcaaatgaccagtctcaagcctccagcaaggttagagtactgaagctgcatttaaccttaaacagtcttattctttgagcaatatgacactgtccaacatattgaaagaagtgacaaagaactgaagtccggccctcaggtcagccacttgctgagttaagattctctgcactttttctgtggtagcaccagatgtctggccttagatgtggtgcatgtggtgagattcctcgtgttccccatgtcttagtacttattactcatcttccctttcggtctgccttccccaaccccattctcatcaactataagcaggcaggcaggcaggcaggcaggcaggcaggcaggcaggaagaaggaaggaagagaggggagagggaagaagggaaggaaagggaaaagaagagggaaaaaagggaaaagggaaaaagggaaaagggaaaagaaaaagggaaagggaagggcaaaaagggaaagggaaaaagggggaaaaagggaaaaagggaaaaaagggaataaaaggaaaaaaagggggaaagggggaaacaagggaagaagggaaaaaagggaaagggaaagggaaagaaggaaagggaagggatagacatgttggcagttcctgtttcttttacttttattgtttagtaaaattctccagttattattagtcacaaatcaatagaacagaaatgtgatgaattagaatattttcaccactgcatcaactttgttttcttagatttgattaactattaaacatggaaacttgatgacaattcttttgaacacgaagtaaagaatttgtttcccagttagtgccgtcttcagagtttgaacttgggttgagggagcccatgcccgtactcagggagcactaacaccttcacgtgctggtaaacgcatacaactggtgttagggctctcaaggcttcctatacaccgaggaaacaagagatgatgccgttttatagagctggtcctgaaagaagcttaggttcagatgttgggaaagtccccagggaatagagaagctgggcctcacagcaccataggcagtttttgcaacacacatgttcctttgaggttttctgataataaccctgtagatgggggagagaggcacattgcctagcgtttgacatgtgatgctttgggaggcaatagtggtagtagtttcattgtgagagttagtaaaggtgaggatgctcaggtaggtgggggtgggagaaggtgggcaggatgacctgatagaaagcaggctcagcaattgggttgccaagaacacagagttccaggtctggagtctcacagcgagcctactaatcagtcattcatcacttgcaaaatataaaagcttaattgtatgaggttttacagctcagaggggattaggacaagagatgtgtttaaaatacgatgtgtctctctgtctctctgcagctgatggagcagttaaaattcagctttgatgctgggcagttagtgcttgagcaacttggggaaatgcagtgggctgtgctgcagggcagttcagcccccaattctggctgcaaaatgtggatgctactatattggtttcaggcaatgaagaagattctggggagggggaactctccattttctcatttatccacctgctttccatatgcctggaattgagaaaattggactctctgtgtcatcttgtatgggacagatttttcaaaagaagccacatgaagaaagtcaaaattggtacagcataggtaaagaaaggcctcttgcccagtgtcaacttgagttctataattccattggttgttttaaaaagatctaatctcagtgtgaaacagagaccagacaaacccacttgttccagggtaaactcacgtagcctaacttcagaaaaatttgtgccaacagaacttaggtaaaaacttaaatcttgccttaaaaattttttcctgtcagagatggtgctacccagccgcctatgttgggaattttgtaaattgggttgtaaatggttgtagatgtgagtgtgacactggtgactacttcggctacaggaactgaggaggtggcagctagttctttctgaaccatgagataaaccactggcaatcaacacccccccacacacaccccgaaaccctcgtgcaaggttgtagaggctaataatggtttggaattctggagagaggcatcaggcaaagaatctagttggaactgattttccctggtagctgagtgtgcagtgtaagcccacagcctgtggtgtgtgtttcagaggaagaaggacagtaaaactttccccaaagtgcatttgttagcactttagaaaagctctaactgttcacatcaaagaattaaagtattttcaagtttaaatgtcttaggtctgttagggaagacaggcactgtgcttggtgtgtgcacgaatgcatgtgtgtgttcatgtgtgtgtgcgtgtgtgtgcctgtgtgctgggcatggatagacatgcctgtatttgagagtaggtatgttctgaaaactgtcccatccatccttatcaaaattacaaagaaatggagtctaatatctccactaacagtccaaaattactattttctttgtgctcagtattacaaatcttgctgtttaaaaaaatatattttaagtatatcttcttttctccagaagccatcctttccaattaaagttaaatgtggttattttctactctggccccttattttccaggacacagtgtttgtaccacttccgtggtgattatggaagttatactgaggttcctgggcctctgagtagctggaggggagctggtgctcatagggggagctgggtttagaaggctcggtgggtttagatagtttagaagctgctctttctttttttctgacactttccgggtggcagtcctttgctctaagccccatctttgtctccagtttgtaagcatactggaaagtgcaaactccatgacaggtttctatgcttaattcacaccagcaagtaatctttgcagtcaaggggactgatttaatggcagggacaatttatttctctctgggtagttagagacagctggactctaattcttgagagcctttgttcaggaacatctgggttgaaaatactatagttaacagatgatgctggtaataaaagaaagggggctttgtataatggcatagtcaaatttggtagacctcaacttaataattataagggaagcaatctaacttgttattacaacagttttattgcagatttctggtttaagacctttttgtgacaagtggcattttcccctcttggaggaaaaagggggggtcatttttatttccctgtagtttttgcaaccagtgacaacttcccactctggacatattgggagacttcgttttagaaactaagaattaaactcttgctaacttacagctggctttatcttatttattatgctgtgaagcctttttggattttttttctcattctttccccagccctgattggttttctcaattctacacaagttctatatacatggaaatacagcgagctgagaaagggggaggaatagagatacctgtttaatcaatatttaaactatagatgcatgcagaggcagacatcaataaagatggaaagggaaggcagtctgagtagtaggaaggggtgggcactgtgggacactggagaaagtgaaccccctgaggagtcccttttagctccatgaaggatggctccagtgtgaccatatttggtttgccaaggaaagctgagaaaccagttttatgaaatcacatgttgatgtctatttccagtatttgaaggaatactgtgctggccaaatagtgtgggccagttgcacttttggcttcctctgctcatccgaggatcagcagcaccccacaccacatggagactgaggctccacttacctttctaaatgcaaaagccatttgaccttgagcctgtggattttccctcctcagacttcagtttgtcttctatagaaggaggctctggtcttctggagggcctcggtttgatctccagcactcacgtagcagctcgtaaccatctgtaactcagtgcacaagactgcctgcattggattcacttacgaagggatacaatctacttttgatcttagctaaaatgctgtaaagcaaccgaatgcacacatagcagcgaacctttcccgtcccaacaggaggattaagtctgtacaaacaatgaagaacttggatcccatgaactaccagactccaagataaaaatgacagtggtcccatggtctctgctgagatcactttcttactgaatttttttttatttttatttttggatactgtttagattcatccagtaattttcttcaacaaacagtgaataaagaatatgacttattaaaacagtttaaacttcaggaagagcagctctacaaggagttaatggagtgctatggaacataaactaagaagaccatttccttgctatagttggtgatacttgggtcggtggttcagaactgttctgcacaactacctcaaggtctaggtctagcagaccagtagcaggaatcagccttaaaattgcagggagagcccagatacactgtacggaagtgttcctctaaagcctgattgtcaaaagcaatattaaggagctaggacctctcatgtaagaaaaaacagttgatcttattttctaaagagaatatgaggtactcacccttcacccgtacctttcttgcaagctacacatctctatgcctagcagatcttactaagtcattttttcaaagatttatttgttatatataagtacaccatagctgtcttcagatacaccagaagaagacatcagatttcattatagatggttgtcagccatcatgtggttgctaggatttgaactcagaacccctggaaaagcagtcagtgctcttaactgctgagccatctctccagcccaagtcaattcttcattgtagactaactacagggaatgagatggtttagttggtaaagtgcacattgcaagcatgaagacccaagttcaatcctcagcatctgtgtgaaagccaggtttgctctctatgcatttgcaatcctaacgctgggacggcctgaacaggaagattcctgaatctcaccaaccagacagttgggcagaattggtgatcttcacctccaactgagagaccttgtctcaaaaaacaatatatgagaagcagtcctcaagcagacctctggcctccacaatgtgcacatgcaccccttacacacacatatatctgcacataagtcaaatcaactccatgtctttcttttactgagaataagcaacatataccttgaaggggccttttacccaccttgttttctgacccactcatgatttgtcttgccttgttctttcaatgacagctttataggctctgtatctgattatcaaatattcagaccatttccctgcctcaggacttttgttcttgccatttctaccccacacttgaccccagagatccctttcccaaaccttctcattcccatctcatctctggtgctctctgcatcttcagggtggtcctcttaaacccatttcctagttagtctttattctcacaagtcaaaacaatttctacatttgtcatggcctagaaatttattattgattcacatatatattggcttataattgttctttcccgatgaaaaacacacttcactggagaggaagatgtatcttcctcctagggtcagccagaggcctagtacttaaccatggcatggactgtgtgggtgttctaggtcttagctttagcagcagtcaaacagaactattgatgaagggtagtatccccagcttaggaaggtgtggagaagtcagtagagccatcaaggaaggccttaccctttgacctaataactctttccatttactgtgctgagccagggctcacttgtcattatcactgagtaatggttcattatttaaaacctcctaaaatataccataatgcttattatagaaatatgggatgcataatatatatggttcattttttagttcatgtgagcccttatctctttaaatagccaatgcacacctcaatctaaatcataatatatgaattcaggtttatatttttttctttgtggccttaacatcttaaaacaattttcaaaattcatttattaaaacttttctactccacatgaataagactactttgaatctttttctgcacaagcatgctatgacagctccttttattttcttggagttgagacactgtgagtagaattcatctccgtaaggagttcctctctgttagtgtctccattcaccatgcactgtggagaaactccaaacgtcttgaagatgtttctgtggctgaggagagaatgttcagatatgcacaactatgagaagcagccacagccagtgtaaacttagctaggagctaaaagatttgcatctaggaaaggagctagagatgttttggaaataaatctgaaaaggaagcaatagtcagaatactggttggaggatagacaagatatgacctgggaagatggttggcaagaaaagagaagaggaaatattggggggcagaaggggtacaagagtgaagccagagaggcaggaacaagcctgcaggaaacagtctggtctgcagcccagaactgtgggcagatgaggtgagacagcttggatagagccaggagtgacaaagctgtagtcatgtgctgggcacttagacggaggctaagtattattaccatcattccaagcacacaggggtctgctctgaacaacaatataggccatttgtacaaaagaccgaaatggaatccaaataacaggttgcactgctccaagtctcccttcccccgcccccgccatagttaacattttactacccaactgagtaactaatgaatctggcgggtgtaaatccccagacacaaatctctgcttggggtctgtgtctagacatccagaccagagcccaatttgcacttatcacttgtggggaatcaggtttaatgggggatatggggaggtgtcattttactggccctgcctttggcacctggcggtagactgaggatcccctggataatgaccgtgttaggggactggaagttcctaggtaagtttggtatatggctctgctatcaggaagtactgactgggaggcctttccttctcattgcaggctgtgttttgtgaagcttaagctcctgatgatagccattgagtacaagtctgccaacagagagagccggtaagttgctgttcgagttggaagtgtatatcctgggaaggtccgtccatgttctctttcttgaatatgatttatttgtttggaacccaactcagcagctccctgaccctgcaaaacatttcaagacatggcaggctctgtcattccatgtcccagtgggcatccagagacaattaccctggagaagaggaggagaggagagagacattctcagtagctctacccactatgctatgccttctatccatgaaagcaggagcagattccctcttgaagccccttttactgctgtaagcaaaaagcaggtggcctctggccttccttacaagcagcctgcagtagagctgtgatgggaggtgccagctccctcaatagccaaattgcaagcatcctattgtgtaccatatgtgtttctcccaccgcagcccatatccaggtggcagaatatcagcttcatgtaaattagccaggagaggagagctctgaggcaggagctctcgttatttatttatttttccgttaatgatgtgcaaatcagactgatgagggacggggtctggctgaaacagataccaccccagtcgatacatgaccttactgctggttgatggcagcactgtatgaacaaggaatccagtcgaggggtcctacatgcagtattgataacataggtgatctttgatccttgactcttagtcatagttttggaagaaagagagctggttgatagatagagtggcttttgttctctgaaatgacgcatccaggtcctgtctatgctctagtgaggcctttgctcctccatgttcacaagggcagagggcagcccaccccaacacacaccttcataactgaacacaatatagggcaacacttgctaggtcatgctagcatcgtttaaggagttttcatgatcttgatgaatgaccatacacacacacacacaaacacacacacaagcccatttctaagtgtgtatctgtgaccaaaacaaaacaaaacaaacactagatcacaagtaagtggatactatgttgtctcttccctgtaagatcagattgtccaaggtcaatctgatcgaatgctgcattcctctggaaaatccaaatcaaccagacaacggaagataaaatggtagatttggtggccatgtgtagaacatggtggcagcaattttaaaattacatgtatggaaaggatatgtttttcttttccatgttggcaaaggaaataatattacagtattgtttgagcacgagagaagtccagccacttgtctttcaacagttaaagtataattttctggggtcactctttgctcctctttattcctggcttcacctggacccatgtttgtggaggagaaattatgggtccttgctttttttttttttttttttttttggttttctgttcttttgagcgggtgagcatcaccaatggtaatctttgtggtgccaagtcagtacacttttgtggatatgagtgttttctctatatcacttttatccatccctttcaaagcataagtaaataaaaataaagaaaagtgtcaccacataggtgatgctaatgccaacaagtgttttcagagccttctggaataatctatggcaagagaagactgcaccaagccacgagcatcagcccatcagcttgtacataacttctctctggacacaggaaaagaaagggcactgctggaatccaggcactgttctaggaaaacagattccaggttctatgaagaaacaatctgccctctgataggccttcttattgggtggtaacctgagctattttcaacaaagccatgtgtagtgaaataggttgtaggttttgtttttctcccactgcctcagaaaagacaaaaacaaacaaacaaacaaaccccaggaacttgtttggctttgtattggctttctgtgtgtagttgccagcattaatcctcaatgtggcttggtctcagtgtggaagcacaggagtgcttgtgggaaaaggtgtgctggagggaatgtggatcagacgctgccccactaaacctaggactcatccaacaaaacattttaagtcccaaaccacactttttctctatccttgtgagaaacctaatcttgttcctttccaattttgtaatggaccagataagacaatgtagagaggcctcatctcttccccaccctcctacctctgacctgtgttaaaggacattctctgttgttggttccacccatgatactgttttcatgctttgctgataaaccttgttttcacacacatccttcaaatgctttgaaacaaaggttttattccttccttcttcctggtgtcagtcaatttattatcaaattgtttgatttgaaattcttttcttgtcgtttttgcagaagccgaaagcggtatgcattcttcgttaactttccttccaatctccaccctatgtcttcactcctaaccacaggactaaccatttgccaagaactcaagaagagagagattatatatgtgtatatatataatctccttcccttgtctagtatatatatatagtatatctatacatatacataatatatatatacatatatatatatcacctgtctccaactagaatacatcaaagtagcctgctgttgtcattgtttgatttgttgattattttggttgatgcactaacttctttgcaggaaaataaaaataaataaataagcaagcaaacaaacaaataagtaaattaatggaaaagcagagtcctatcttcaatcatagtaccaatggtggtaacaaatcccattacagttgaaaaggaggacagttctctccagccctctgtgtctgttatctgtattgtcctgatgttgtcctggcgtccattagatacaggcatcattttgtgttcattgcatatccacattcccagtgacctccacgtctctctgttgagttttcactttgtagatcagagtttctgtcctttatccacaaaacagagaccaagcccttgcacttcttcctctccttgtattcgtttgggttaattttgttttgactatctaacatcttgagcagtgccaataataaactgcctagctattatgtttatgttctataataagcatgtttgttgggacaaactcatgggtttctttttttccttgtgtgtttgggcatctttcttaacaggaagtatctaagcttttaccatgtgacttcatcctgttttgccgctgttttgtgttgcatggagcatgactaaattatcatcgatggcattttaaaaaattatttgggttcaggggtgattggtgttgttacattttttttttcagcatagtttttcaataatgcaatctcttagacagtgcggctgaaagtgcaatgccaacctgttcacgttcttctctgtggtggtagtcgctgtcatgtgtttgtgttcatacttgtgtgtgtgtatgtgcgcctgtgtgtgcctgtgtgtgtgcctgtgtgtttgtgttgtttggcactctttccaatgtcagatcttctgtgattttattttgtagtagatgtgaatagaggtggcttcctgtcagtttggtattattgacatgatccaactgcaagaagttattgcaacactatgcatcttcaaaggtccacagtggttgcacctctgctgttggcttttggccttgggtccttttactttgtggttaaggcatgttgtgatgtaggcatgacttgtcttaaagtgtaccagaaagtatggcttgctcccagaaccacatatccagtattatccttcctagatcagctctctctattctctctcatgaagttagtcttttttgtaacacaaaacaatatattgaaatttaagatgattgatagacactcaggctaaaccagatcttgccaatattgttgtagaccacagtgatggctatttgagtttggcctactgggagcaaccttgattatggtgtctctgtatgtaaatggactagacctatgcatattgaagcatggaatacacaaactgtgtcttctacacatattctaatggaaatgcatgtgtctagttgtgtgggactccaacagcacttattgtaaagcccagaagaaatggaaaattcaagagaggtgataaggtttgagatttgttttgttttttattttcctaagatatgttataatacagcacaaactgcattgcagttgaacttcctgagagaggacacaaattggtccaaatgaagttcctgctgacagtaattgtatatgcccatgagtgatcacatagatatcttcccagtggtgtgattcttctggacatagcatggactgaactcctcaatggcttggatttgcttactctgtttaatgaagtcccattagcttgctagacacaactaggattacagtgttttcaagtataaactataccctcacggaagttgtgatattttcttaattgtttggggaatggtacacgatgccttgagggggtggggggttgggacataggcatacttgtacacacacacacacacacacatacacacacacacacacacacacacacgcctatttatccatggtggattacagtctcctttaatgtatctattttagttaaattaccaatcattggtcatctcctcaaatagtaaggtttaggaagatttaaggaaggacaactaaatactctacagccattgcaccttaaatattagagagaggaaaaagaagatttctccctagcctagtcaagattttccaaactaccccaaattcaagcatgggatagccaatgaaatagattgcaaggtagtgtctgccttaggaccctgttacagatatctgctgttgagtagagcccattccatgtcgatgtgttctgcaatcagaaacatgggtttcagttctaagtaagttgcgctttcagtatggaaaccaattgctccagctgcctaagtgactcactgtttacatttgcatattcgcatatttatacttcatagcttggtggtcaatccacaagaacttgtggtcgctcctttgatcagcctgactgatgagaactacagtttgggtttttaaaagaacaaagttgctgctttcatttacttgagaggaaaggagaaactttgagaactgcagccaatgactatgacataggcttttcattcattctatagctctggaaagtaccaatagtatgtaggaatctaagctctactatgagaaactcacaaataaatagagggatcctgtttctcagtcttccaatcaacagtggttccttataccttatagaaagtgtatgttttgctcttaaagaggatattatacaaaaactaagcctagctgcagaactagaaaagcaatgagggaaaacttttggagaagggatgatacaagccctgagtggccatctgtcactaggcattttcaattaaaatcagcaaggtcatggtaaaaagaggataatttatacctttcttaaaatgaggaaatgtcttctcctgccaagatgtccttgttggaattttgttaatggatatatgggaaaggaagcctcttgataggaccctgctcttagagacacatcttgagttttatctctgataagctcatgacttagaccaaattggagccagagaactgattgaaaatgatgtttggggaggaggagttttggcatcccctaataacaaaataaacttgacattgaataacccccagagctcccagggactaaaccactaacacatggtaggactcatggctccagctgcatatgtagcagaggatggcctagttgaacatcagtgggagaagagacccttggtcctgtgaaggctctatgccccagtgtaggggaaagccagggccaggaagctagagtgggtggattagtgagcatggggagggggaagagaatggggtggggaggtttttcataggtcaatagcaaactctaagtcttttcattgggggaagaaaatgttattcttgcctagaattcttatctacgtttccaagaagggggcagggctaaaattttatttaaatgttttagattttgaatgtagataacagttatgacatctgcaatgctaaactcaggaatgtatgtctccgaagagtctttgaagcttacagcctacacagaaaatgtctcatgttgtagacccctgggatcacaggcctgctcctcactacccttagaactaagtctagcctatctggcacaacgttccttgtgattgcggacttcttccatttacctcaggggctggcctcattcttttgaatctttcagctccccaagactatctcagcctaatacttcatacagatataactttaatcttctcagtctgtccatagggaacatgagggaattctggggacagtgagccatctatctcttgcacatcactgtaaaactcaagaaatgggagtgactctgtgtgtaccaaagttaatttacagtagccactttccagatgttgtgcagagaccacatgttcacaagaggtcaattaacatcgaagacaaaatggcgagcaggctggtaaagctgtaacagcttgtttactctcactttttaatcaccggctgatatttatagaaaccaaagattaagggcatattgtatccttaacacataagcatatgcctttattctcttagaaacattgacacccaggggttatatattgcatttcctggattaggagagtgaggcttagctgcctccaaatgaccagaggcagaccccaatggtttctggatgtacgcaccttagtacttcactaacaatgctagagcctgagacttgaatgcccggtgacctccagcaccaagcaagccctctccagagcactgattcagttaaaaggcatttgaagaccacaatacattccgttgacgtgcattctctagacttcaaatcccgggatggcactgacctgcattctctagactgccaattcctggatgtcacactatagaccaattcttgctcagtgtacatgaagatcgaaggaaataaaaaagaaacctctcttgatgggaaccttgagatcactgcatctcacaaaagcactgtgggctgcattgatggggtacagataatggggcacaaagcattagggaaggaaacagaggtctttgcgtatacatgtcaccaatacaacgcctgtcacattttatctttcagattccattgttcaaatcatgataggaccccacccacctacccacccaaaacctgggaagtcttctcccatgcttatgtgaattcttagcaaaaggaagacttccttaacttttaagaatatactttcaaggctccagaagtgtgtggaattttttaaatagatgaactcatgtgttattctgtcacgtacagtttttttttgaaaaaaaaaaagttataacttcatctcacaggttattattattatttttttaataagaaacacagtgttccagtctatcaagccaggagacctctgatgaaacacaatagacctgggcacttttgaaagaataaaatgataacaataaccataaatgaaaagtattgagtcattttaacattacttagttctttgaccaaacactattgttagcgttaccactccttttgtggggaagaacattatgctctaggttcagggactggcccaaagttaccacctgcatactagaacatggaccctacttctgatttcagaggcaatcacataggatctgcctttcaggaaagtgggacgaaaatgtacatctaaaatgccttatttaactgacttgaaagggaaatcaatataaactgtatagtctcacatacgctttgaggaacacaaatacaatttttttcatatgtatttatcggtaaaaaaaaacttgaataatctcaaacttcatcccctcatgattgtgctaaatcagagggcttgtgatataaaagtgggggttagcagaggggtaattcattataaggtcttattgtaaaacctctgccttttgcagtgtatcattagtgcagactgctgggccattagagtaagcttatggttcctatttcagaaggcatctcattgctgctcgggattctggggtagagcagtgaactcttcacactctgctattattattgttaataacagcaatggcacaagccctgttttctgctatcaggtcttgttacagctaatggtggatgctcctgcaaccacaacagtgattttggcagtaatgatctgatcgcagttctcccaacagaacagcagttttcctgagtcctccttgttttgctgcagatagaggactcctttggcaacagtggtttttttttttttcttccctagaatggtcttaccactagacaaagatcacatgttaattaccatccttcattttgctttgggtagctagggaattttttagcttgagcccaaatatctctttccctaatcaccagcttttcagatcaaaggctattgccattgtcttttgcttcaagttgctaaattcaacatctgccaagctcaaagcctgcttaagacagtctagtgctctgcttttgatctacaggaactggtttgcttctctcatttgctaggttaggatgcatttgtcattactgctatcccaaacctaacttgctcagctaatcaatttctggtactaggagggcagtgtatatttcatttcattcccctccctgcaagacaaggtagttgttttggttcttttttccttttttttaagaggtaatttttatttgtctttaaaacaccgagtgacccaatgaaggaatgccacctttatatcttattcacacaacccatacagttttataaaagcagactgaagtagttgaggctatccaacagaaggtagctttctttataactgtatatagatcgggttctttatgcagtctactttgatgtccttatcagggttccaaaagatgtatagtttccttctacattatatataatataggtgtcttgtaccattccccatggaaatatgtggtatgtatatttgtctgtttctgcatccatataggggtcccatcaatgctatattacctaagggagaatgggtgtgtgtagagcttcattaggctgacagtgtttcaatactggccatcaaaatcagtttcagaatggggtacattctggagaactgtgcttctggtcaggggtatctgggggcagctaaacaactctgttaaacaaacccagaccctaaggcccagatctgctttgattttcctgacttggagtgtatcacctggagctaaaggatgccatgattgaactagatgtctgggccagtaaagatcagtcactcagaaaacaaagctgggtggcagggggtggtggtgtggggggagcattagactagtggggcccctatgaaaacagcagggtggtgttatcatcaaggttttatcctgaacatgagctcatacttgtgtcttctttgtttgtttctgttcacggagcagaatattaattaaccctgggaaccaccttaagatccaagaaggtactttaggatttttcatcgcaagtgatgccaaagaagttaaaaggtaagagtttattttcatctacttttctttctggtccagccaggcaccttgatgtaccaaccccctcgtgttcatatgtccagaactattgaagccccttccttgagcaatctcttcacatagccagtatctgtctttaaatttgaatattaaagttttagaatcaggaaacctagttacctgctctcttgtcttacaaggaaggtacctgaagcccgtagaacataagtgacttcaagtcattcagattctgacgaggattcatgagacatctggcctcttgtctgaggttattttcttaataccatctgggtaaaatatctctgaatattacaaattttctcctgtaagtgccgagtagaattcccaacagtttggattaatttctgatggaacattaaacttcccctatttgtgtttgcaactttctaagcagtggctaaaattgtcagccttaatcatgaagcatctatgggttcaatgtgaggctcaatgttttatgaaatttttattagtgtctttattcctgtctaagcagcttagggaatcatagggctttgcatttcagtatggactatcattatatgtgattccactctgcccatttgaaatgttcactttcagagacaagtaagccaagcaggttactctgtcaaacaactgtgctgctcctatctgctaagccatctctccagcccttcaagtttcttctttatcttggcttggtttaccagcctatgcaaagtaatagtattatcaaaaaacaataggatgtatttgcaaactcttgttgtgccagtatagagcaatgatatttgacaaagccaggcttatgaatttctttcttcctattcaactgtagtgaatggggccatactagtttaaaaagcttacaaggaaaagagcacatggggttgagggctttattttttccatctgagatctctaataagtttactcctgcaaattggaggatgattgacattgctaaattatatgggagaaacacatctctaaccatttcatggatagaatatcctgagacaggagtttatcaggactatcctagatggaagtttgggtgagaatggaaagtggggtgtctgagagagccccagccccagggggtctggaatagttatgtccttgtccagacatggggcacagaagcctgaagcagcatctctgccctaagcatggtaagcagggagcacagctgaccatacatcatgcacacctcccaaacagcaaattcaacctgagctcccatttgtgtaattctatttcctattgcgtctctcgctaatgaatgtcacaaataccaggcagcccgggaaacaaattacctcctatattagggaatgtaatatgtctcgtttctgtgctttatggtgttcacaaatacatgctgacaccatcagctacaactccagcctgtaattttccatggtgtgcgatgtgtcagagcaaatgttgtcagttagggggatttcaaatagatgaagaatatagaaaacttcagagaggacattggaaatttgaataaaactaaacaagttttattttttttttaaaaagtgaagtagattatgttgatttcttattgggtcttcaccctctgctatggctgaagaaacaagactacagcagcaacaacacacacacacatatacacacacgcacacacacactcaagaagttagtggaatctgggtcatgaagactttgaggtacaaggcttagagaaagaggagtgaacccatgtaatcccatgaggatgctactctgggatgagtatttatttgttcatatgcttttaatttgctattcctaaatatttgtctttttaaataactttggaacacaatctggtgtctctcttaccttctttagcagatacatattttgtttgagtcataattaaaaataattgattagttgccaagttaaaagaaattgtctgcttttatattaacatttttagtcctagttacttctgaaaacatgaaataccccaacctgggagtcattctcaaactcactctctcactcactcactcatccattcactcactcatccattcactcactcatccattcactcactcactcacttacccattcattcattcactcactcactcactcacttactcactcagtcactcattcattcatccattcactcatttactcactcactcagccactcactcattcatccattcactcacttactcactcatccattcactcactcactcaagtgtagggagatgctggcagattgtggaggtagagtcatgtgactccatttggattagtctggggaacatgtagtatgtaatcatgaactttgtagaaatgaaggaggagtaggaatcacagctgaagcctagacatgggccatgaaccatgagagcagcagagatgatgattcctcttgctgagatgggaaacaccagaggatcatggaggtggtaggaaatgacttctgtctgggccacagcaaatggaaggttggtcccaaacataccatggagtcatgataaaggcaggtacatccaagagtctgcagttcaggagaaaagagagctgtagatatcaatatggagccacattgataggggttcctggcaaggagcagatgacccacttaagtggaaaacaagggcaaaggtttataaagggggtcgtataaacttgtggacagcaagatgattaaaaccagtgagagacagcaaagcatcttacaggcagctacaggatggagctgcagggagaagggacaaaggtttggtggtggaagcctgggggtgggggtggggagaagaggacatggtgtgggtgtagtgactactcactgctttgctctccaatggagaaatgcttctgctgcttgctatctattccacaacccactaaagagcaacctcatcctttccctcttccagtcacctctgactcttaccaagcagaactcttgtccacagcagaacagaggacaaggagaccctaaggccagcttagcaggatctggagggggtctttctgttggtgtgtaagctgttgggatgaagaggatgggagttgttttggagtgagaagatgagcagcaggaggagagaggagacaccaggaatggggaaaggctcctggaatcaatattcacggattttaactgggacctgtgggattttgtttctgggatctctgagtttacaaggacaagtgtgtagctctactggaagggtattgccaagagaatgtggtggaggcttccatgagtgaggcagctcccaaagaacggtcactcggcaaaactcaacttgaggcttgaagaatcttcctctttaatctgaagaatccatggacacctttagctcattactcgtctccctcattagcctcacctgtctgactgaagcagctatttggctaagtgaaagaagccaggcagagaaagacaaacactacacaatcacactttatatgtgaaaccttataaagtcaagtccacagaagcacagggtagactggtcagttccaaaaagcaggggtacagacacctcaggggataagggtcaagggacagaaaacattaatttaagcaagaagataaatgcaagacatcattgcagagtgccatggccatagttggtttaaaatagttatttttgcatttacttatttatttgtgttgaatagatgtgagaatttgctcaccttgaaggaaggtgagaagacagcttttctccttctgccacatgggacccagggatcaaactcaagttgtcagatttggcatcaactgctgtttcctgctgagtcaactccctggcccataggttgttgttgttgtttttgagacaatgtattgtgttcatgaaaattgcttttagcaatttttcttttcaggtagattttaaaggctctcacctcacatacaaagtaacaactagatgagagaaaatgtgtagccttgcttgatttagccactctgtaacagaatttcaaaacagcacattgtacatcccaaatatacatagttgtgtcagttaaaagtaaaatgtttaatataaagtgttgggttttagtttctttagactcatctctccatctcttcagaggaacacattcaagatttttggcgtctggacttgaatctagattctgccatttagcagtatgaccttgaacaggccatttaatctctccctgcttcagtttccttatctgtaaaacagaggtaataattaagcctctttcaaagggttgtttaaagatcaaatatgttagtgcttctgaaatactgagagcagcacctggcctagagtccggaccctgtaagagttagctgttattactgctgtattgctgtcactcaggagagcttcgaatggaaagaagatggccagaggaagtagattcaaacttacttgccctgagtaagaggatgcagcattgcagtgccttgtagggcaacagctgtcctttctgattttgcagagtatatgccatctgacattggaaggaattgtgaaggagcctcttgaaacaaagagctttgggcttgctgtagaaatgcacaccctgtggaaaacataaaagacctagaattgtgtttatttctttagcctccattgagaaatggccctgtttattcctggcactcagtttcatgttgggagtggtaaaggcgttaagcccaggattttgttagttcctggatccagagggttggaaggttgttccagcgaattttattacctccccagtacagatgcttctctacttatgatgggtttacatcccaataaaccatcataatttgaaaatagctcacgccaaaactgcatgtaacctcctgaacatcacaccttatcccagactggctaatgtattcaagtgcttcaaattagcctataattgggcagaaccgtttaacacaaagcattgttaatatacttacagaatgttgagtatcttctgtcacctattgactcttgtgttgaaagttaataactgagcggttttatggccctgcttctgcaccatctcaagtggaagggcacaagccaaccgccaggtccccaggttactcctctgggtactattgctgagaagtgctcagagcatcttagttcttctcatccaaagtatctttggtacaaccaaagttcacattgaagtctcagattgacactaaagtcagattaggggacattgtcattgttgttgaatgcttcttcttccagcccattcaacccaacctttcctctccttatcccattccagtggtcagcataaagagaacaaaacttttatccattatatatgctcagagcaagctataatggaatggatctagtcagctttggaatgcaatgggctttgaatcttaggagagagttgacaggaaccactgcactctttgtttctgtagtccctccttccctccagtgactctcaagcctttcttattttagttaataagaaacggtgctttcgaagtgataaaggtagtatttatgtctgactgagggtcatcatccttgagccccttaatatatattcaactagacggttgggatttcagagttgtttttaaagtacactccaaagactcagagatggttgaccatgtgttccaaggaccagtactcagtgctgttctcagaaacaacagtcacagacccagtatgtgacatcagcaggacctttctccccatttctttgcaaagtttataaaaagaagcaccaactccaatcacagaatcctgggtttgaaatgagtggtcttacaacaaacatttccgtctgcagatgtctaaacttttcaaaagatgaaaggaaattagggctggcatgtttcattaatttggcaccacctcgagggaaacgtggtactcattttactcgggtggattatgagatgtgtcagtttttccattctctttctccagggcatttttttactgcaaggcctgtcatgatgacgtcacagatcccaaaagaattaaaaaatgtggctgcaggcggcgtaagtagtgtttctttctccctctccgccctgtttcccttcaccacccctcaattcctttttccttctccttttcctattagaaggacattaaacaccaagtgctctcttgaatgtgtttatgtattgtacccagcagtttaaagaaacataaatacctgtcctcgcttcaagcagaagatgaaaaaagaaaaaccatcacagtcagtgcctgggtgagaacctagtacctattgcccacctctctagaagtagacatctctggcccacacagttaagcatcatggataaaatggaggatacctacagctatggaagagggaatgttttttaataccaggatttctagtagctaggtggtccctaagtatagactatacataatcctagtaggaaaatgagtctcagaacctagtctaatcttgaaatcaaagcaccggaccgcctttcggttagaattcttgtaggttcagatttagatcacccccaaacacaaaactagtactcccagtaaagcaatcagccaccaatgttcaaaaggccatcctttacgtcagtaacctcaacgtgcccctacataaggcacattgctttatggggcaaactgctctggtctcagaagcttctgcatagtctgtctcagttgtcttctaccaaagctttcctagggaccctcagtgactgaggaacactggcttatgacttccacagacaacacgctgtaaagctggtctttgctttggggagggccaaccttttgcagcaattagaacacacaccctggaagagattgttctaaacattagagaaagatgaatgaagtgatacctctccttccatgatgacttgaggttctaaaagctcctcctgatggttgctttggtcctcaccataaccctacataattaccagggacatatttaatcaacttagagaaacaaggacccttacatgtttagtgagaggttgaaattgctgatagccatgcagccagccatcatagattcaagtctccgaggcctatcttggtgctgtgttctgagggccctgacctttctgataagagcaatgataaccttgagttaaatgggtgggaagagagttatggaagatcacccccataaaatacatttttacaagcagaaattagtcaaaaggccaccatttcttctaggatatgccacccaagggtcttgtcactgagctgcctgaggggaacgtgttaaaacagtaagatagaaagatggtaccacctaaacattaataagttggtttcttgggaaataccgatgggaagtacttggtctagcgaagttcctgtagaaatcctctcagataccctttcacacaccagctgaggccaacttcttttttttttttttttttttttttttttttgggttttcgagacagagtttctctgtgtagccctggctgttctggaactcactttgtagacccggctgccctccaactcagaaatccacctgcctctgcctcccaagtgctgggattaaaggcatgcgccaccacacccggcacggccaacttcttaacatgtatattctgcttcccccaaactctgtcagcagccctagaacaatttcctgattcgctcaaaccacaaggaacagcacgtgaatatgaagaaaggacaacatgagctcaactgtcagaccctaggcatcactcagccttcttaccatgtgtctgagaacgtagaagcccagcaggcatcctcagagtcattttcttcagaaggaacagggcatcctgagagtagatttaaacaagggggaacaccagagcaagatggtgagctccataaggaaactcgcacagtggtgatgggggtaaaatggctggaggaatgctgaggtcaataatccatgcgagggagtttctataagctttcatcctttgggagccttagtgaagtggtgagactatgggctactacttgagcagccattcaatgtgcttatgagtagcctcttcatgaggttctcttcttggtgccaatgatggaatgccgaatgagattctttccaagcaaagatatctagcaaatacagataaacccatatcatcttaccaaatgtataaacccatagaggtccacttgctaagaagaggacaagggatgtctgaggatatgagggctcttactgcttcatactttggcaggtcctttgggaggtggtagtggagatgagatatgggtgggaggaagagcaagggaattgactgaaaattaggaagccatttgcagtgttttgaggatggatagaaggctgctggggtctatgacactggagagtgatgtacaaagtgggatcacataggaaggcagagaagaagccgacaagctgaatttcagtcctctgcctgaaaactgccaggtaattttgggaaaggaggtggcctcaccaggtctcagttgaaaggatcccctttgcatctggatggagagttcactcaggaagacagaatggaagaggaaagttgaagagagaactctcactctctctgaaattataatgtcctttataggacattgtggcacatcccatttaaaatccttataaaaaatttgacttccagggtatttttttccttttcaggcaagtagacagcagtaaacttttacctttcttgttgtgaaaatcacactataatgtacagtacctttattcccttaatttcccttgtagtaggttaagctagtgaaatgtttgatctgccatcatgcatgagacacaattgctgcaaaaggattgtctccgccaagctactcttaagtgtggcaaggccataggctgtgtggttaatatttgatactaatcagaattgtccaaatgttgttattcccaattagaaggccatagcctggagggcaggatgcagacatgtttgggaggattagaataaaatgaataattgaatataaacctccctatgaaggccaggcactcaagaaatcagagaaaatatgtttggctctaaagaaacttttacaagaaatagttatcattgtcattatatataggaggatgctaaggtaccagccaggcacctcttcgtgtttaagattggaaaggacagttgactcacccagctatttatccaaacctcttagtgcatcaattcaccatggaataatacagcttgcacaagagcaaaaccactgacagtctccagaccctgtatgttttcccaacctcctgtccctacccagtttctccttcccattccctccctacctgttccattccttctcattcaataaccttcaatgtttcatgtcctcaatcggcgaagtatggcgtgtggacattccattgtggagatcccgtgctggtagtatagtttaacatgcacatctctttccatcccttcctagttctccatctgttcaggaagaaagtccaatccagatgtctagccaaggagcaatctctcaggcactagcatttattcattttcttttctgtgtcacaaacctggtctaatgatttatactttccctcctcccagcctctgaaaagttgccagggagagactcctgagggacaagtcatgtctagattgatgtgtgtgaaagaatttcctttaatttctaatcattgacatatctttgatttattttgtttcctctttgctgccttggaatacggcccctactctattttaactgcaccctggtagtgatctattgtgagtaaaatgggttccgagcagcccagagtcagttctcctggtcttttctctagatgagatctttttttttttcctttctgtacagttttagtttcattttacttttggtattcgtgttgcatgtagcagttacatcatgccccaactcgctcatgccctacacagtccttgtagagtagccaggaactggagagtgcccagagcccactctctatgcttccacccatcccccagcctccagcaagctctggacacggtcttatttttccattagaaaataagaccctgacaacagtgtgtttctcttgaaggcctttgctcaggacttttaagggacactggttaggctagagtaattacaactctagctatagatgctttgtccattgggggtcatagtcatgcttgcctttgataaacgacacttgtttttcccttctacagagcttgaattcctctcttgaaggaaacacataggctacatatatattcctaagttgtgatatatatatgatatgtcctggggtagcttatatgtaaaaatgtgtatttttatatataatcatagagatattccatagagagagaaatacaacgatcacattatagatgcctctctgtacaagaaggtgcttgctggagatttaattgaatactcctttgggactgtaagtatctgcctttctgaagacaagtggtaattatttcctacagtctacggcatttccttgctttcaaaacttctccttaagtcaacgctcagtgattcctccacagttcctctgggaaagttaagcatcctggaggagccatgtgcttatttcagggcaaaaacaaacaaacaaacaaacaaaccaaccaaccaaaaaacaaaaaacaaaaaacaaaactctgttagttaattcaaggagattactctttttttttttttttcatgagtgaaccatgtaggaatctaagcaagcctctagacttctctaacttactaaagacataagatccctgtcatccaatcggatatagttttaaaggtcagtatttctatgtataacctacaactggcagacatcaactttgggtcttgacttacagacataagactctctgaaaacaggagacccaatgtacaactcattgattcattggctctggactatggagatgtatcagcacccaggtctttcatcttcctttgcagaagaaggagaaggagaagaagcaagttgactcccaagttctggtagccttcactgtttggaaaatgtataatgttctgggtgaagccaaaacaaaatagcaaccttcttcaatacaacacacagttctgcccaaattggctctgcggaaagtacgtggaagcatcacttctacaccctgagagctttcacactctagcactctttgagaactagacggccacacaaagccagtcaacacacagctccagaggcagtctctctcaccttcctctgccacagcgtgactgttgtgagccagatcaactagctgggtgtgtactccaggtggctgactttaggctctgtccttgcctttttctgatcacagaaagccatgcataagacttttcttcttcttcaaaaggtaacaggaggaactgggttcaggggagatatcatttctcatttataggatttaaaagaccctcttattcctagtgtttcatctaacaatatacctcagacaaaagggtttttcttttgtagaggattttgtttataatttgagcctttgaagaatggtttcatgttaagaaacaatgcttcccttccctagactgatttaaaaagtgggctgtggtctaagaagtgtgccttaatttaacagcatttttttttcctttcacactagtctcctcttacatatactcccttggagaccaaattattttccctctagcatctggaaacctccactttggcctctttggcaaggccacttttcctctcccttccaatccaccccccaaattaagattctgcaattgcaacttggctggccatttggttgctgatgccggaggtagatggcactgcagacagcatgggctgcaacccttccttccattccagacttggtgcagaagggccaaccagcagaggacctgaggcctgatacctgattgcatcagtgtgccccaaggaaagaaaagtgaccatgctccatctgcagcaggtttcatttcttagcaacacgacctttgacaacagaggaaaagtcgggcaagtgtgtctctgagaaagccttccactgtaaacattcaacagtaaacagatagctttgatggtgtccactagggaagtacttctgttttgtctctataaatactactaggaagtcataatggaagtattggatgggcatccattttattgtgttgaagagaagcacatgaaagctttcttctgaagcgatgaaactgctcaaacaaagttatctgttttttagaggaaggtgagacccaggatcagactcttggcactgacatgatctcttcacatcattggtactggtccaagaacaagaacattttgtgggccaaagagaaaaggaagtctcgggtggcttatatatttttctttcccagagttaagttggcctatgggggcagtttatagagcataaagttccaagagccccaagacagagtgacaagtagccacaccattaataatctggcccagtccctctctcaggaagctgctgcagagctgaggcatggggaccccatccaccaatacacttaaaccaatgtgtttgcaagttgccactgttgaccgccccaggatgctgtcccaggacctttcagccatttgtcctcactacccctaaacatccgccactgaactgaaataacaccacaagatttcaagtcttagagaggagacaaggcctaggagagatgaaacagcaaggtcagggtttgctctgttaaggagctgcttgctctcctacagcagtccactagatgtcctcatagacctactctgctctgctctcacactacagaaaacattttcattggtgactgggaagagcggtggatggctactaactaagaaaggaactcagcaaacaacagtggagagaagattttcttactttctttttttttttttttaatgactaggaatacatgagaaacgtgttttaaatagatactgaagtattgcaagtaggtctgtgaaactcaaccttaggggtttaaagtacctctctgatactggaaacaaatcctctgacccaaaatcggatgtacaaaaaaaatagccactaagaaggctctggaaatctgtaattcactggaaccaaagtgaagggttaggaagctgtagagttgaggaaggtgacagaggaagtctgtgatgtagtactgatacaactttattttataacccaagaataaaatgcccacatattctggaacacctactacaagggaggcaaatcttcagcttttctttgctaatcttcaccatgagtaataacggtccagagggaatctcttaactgaacatacatccctcaaccctgatggattgctccatcagatgcaaggtcagaatcacccttctcctcggcttaggaaacagacctagaagcacataggtgatgacacacgtgactggggtggtgcagaaggggggcacacacttaactggttgtctttactctagaccttgtggttcatgaaggtttgtcaatatgtggggctcaatcatttttaactgtttttgtcttgtctctgagcctcatgttgatcattcttgctggtgtgtgtgtgtgtgtgtgtgtgtgtgtgtgtgtgtgtgtgtgtgtgttgctctttgtcttttgagatttcttttctgcatttggtgggagtgtgaaatgactgggcaggagtgttgactaagagcatgttttctgttttatgcatatgctgctctggaatgtgactgcttataattaacagttaatcttcttatagcaaatgggtttctgctgcctcagttaccagttgcagcctgttactgcatgctaacaatatgaaattttacaacagtgcatggtctccggaacagccaaccatgacagttgcaaacagtccctgaaagccactggtttggtgttttgctccttcctgaacattttggaagtgggaggcttccattgcccattgtgacaagttgacctctgtggggggaaaaagattccaaagttacctattcccatcacccttccatatgtatatatatatatatatatatatatatatatatatatatatacacacacacatgaactttctttccccataaatgtgtcacattctattaccatgcatgaacccgaaatggcagtatgaaaatgaaaaccagggactgttgctaatgagaaacatagcatttctgagtttgatgggattttctgctacagcatttgatttaaaaacagaaaaaaagaaaacaactttcaaaataatttatctacagtgaaacaacaaacaaacaaaacaaaaaaatcatctccattctcctcgcctttgtaagtaacaggtccataggtccagttaaagcattacgaaagaaaaagcaaaagactggctttccaagttaaataccagatctggatacgattcagctaaatttattttcatgtcttccattgaagatttttcttttctcccattcttgacttcagccactgctgttgatcaagatgacctggacattggctgcaagccttgggggttcctctgactcaaatgctatggcagattcttagttttattttttttggtaacaagctaagagcaaaagaatgacacactttaagttgaacagggctggggttgcatgttaatcagtgcaacagttaggatgctaaaggaccatgtcactgggaatgtgagcctattcacaggaatggagatgctgttggaggtctctcattcatctccccccagtgcctgctcttcacagtcatgatgttctccttgcttgacaagcccactgtatggcaagtcattaaggtcttagaacagggcttgacccatgtgagagatttaaaccctttcctggtgactgtaacattcaaagagagtaaaaccacaagttatattttaaactaagacagtgactattctctacaaaggaaaagaaataaggatagtgtggaggacggggtgggagtggagataacacctccttggtccaagttcagtgattggctgtgatacttggaagattaatgagtttttctcctaccctgtaagaggagcaggctggttcctgctaagtgagaagcaaacatgtttgcctgttgtagcatcaaaaagaggtgcagtggcttctcttgtactgaaatataaattgaccacaagagtaaaacaggaaacaatgggggcattaaattaacgagctttgcatgtcggtatttgaggtggctccagggtcagtaccaaaccttcacactatgccagagtcttaaaagaaccactgagggttcctgaaaatgccagcaagatatttcacatgccaagtatttcatgttttgttgtttataatctctcttggctaatattttctgtgtaaggaaaaaagtatgattaaaccaactaattgccttctaattctctggtgggcagggagagaaaggcagctctcccagttgatactcccatgagtagctaaaagcaatctaggaaaccaacatctcatattgctttgggtgatttttttatttttttattttttgtgaacttcctttaatgtatccagcgttagccctgagtagaggcatttcttatatggacagatttggatatttgttctgtcaagagtaaatttaaattcctgtagctatcatgtaaactcactcccgggaagttcagcgaaagcatcctcagatctgatattaacacgtaatcgtttcacatttaatttgatggaaacttgtcgcaggctctgcttaatgcccagaaatagatgaaaatgagaaaacctacatattagatatgtttatatcctgcaaaaaacatttattgtaccaaattagcaattcatttaactgattggctgtgtgtctcttttgccctcctgcattaattttgtcagggggagaatggtggttacatcttttttttctgtctgtaatttgctttttttttttcatccaagaaacgggatgtgttcagccatgccttcttcctgtggtcacggctccatcgaggggacaaaaatgatatgcaacagcctttgggaatgataaaggcaatttatattttcactgcttctttttatttttgatgtacaaccaaactgtcaccaacaatcactgcattttttttcttctgtttctgggtcaagactgttaacgtgaactaagacctgtgttcaatcctccagcgcccttccagctgccttgctgtatgtgaccttgccattaaccgcgctcttcctctcctcccatccaaccacatggttatagccaagatgtccatctacaagagaatgagacgagcatgttgttttgattgcggacgttctgagcgtgactgctcgtgcatgtcaggccgtgtgcgtggtaacgtggacacccttgagagaaccttcccgctttcttctgtctctgttaatgattgctccaccagtttccgtgcctgtaagtttaacctcaacacacccagttccatgtctgtgcttgtctgtggtaatcagccctgtgttttgtgttgtgccctgtggtcctgtaagtccaccgagctcatgttgccattctaatgtggtcttgtatgtgatgacatgttgcttgtgttcctgtgtatatgatgaaaaggctttcccttttgccctggtttatgcttcttgggatagtgaacaaaacaggcatgtgacagcctgcagatggtcttcctctctcttgcctaaataggtgaagatggaaagccaagtgacaggatagcaagcactattttaatagaagatatgtgaaaatgcaggaatttggatttataagtgaccattaattggggtagagtaaaaagatggaagaaaaggaataggagaaaaggtttgctagcgtttcaaaatacaacagcatctagatgcagatgtttgttcatatacatgtgtgtatattcatatgtgtgtgtgtgtttattcctatgtatttcttactagagtctcattccttagtaccagatggtattttcagttcttaaagagaatatttatttttaaatctgccaacctccatagactggtaatttctagtgcttctttcaaaaagttggctcgttcaaaggaggctcctgggacactcattaacatcttatattttcccaacaatttagtcccactttaccaaggtattgtgcagcagtcatgagtctgaatatcaaaagattgacatcccaaatctgcaggattttcttcactttatggctcaggcctttgtcaccgccaggctcttccctgcactagatgccgaaatagttgtgtgtttgacagctgctgagtctgatgaaccaaattcctcttccatttccatttggctggcacagttggtagatgatgttgttgtggaatgctttggtttgagatgctgagatgtctttccttgtccactggcaggagatcttaaattctgcacaaggacttgaatgctcttgaactacgaccataactgtgagctcccattggtgatagtataggaagtgggagacgatgactgtctctccgtgctttaaccatttctcttgaaagaacccagcacaattcttggtgctgttttggcactctgtccatccactcttcccctgaataatcaaaagtagttaggctttttcttccttgctgtggttcacacccaccacaagggagaggaggaacatttagtttctgagcatttgttcctatggcaagtgtgtgtagctgagtcaccattgtctgtgtcgaagatggcttcaacacaatggacttgagaccacaggtcactgtctggcaggaaagataactgccttcactagctagattgctaagccatgccaggtactgatgttcaaagctccagttcgtgtttatagtctgtaagttgtgtgttgaggtatagactaaaactatatattgaagctatatattgaagaggcttgatctgagaccagtgagcccccttctgtttcacaatgcattgctccttgaaaagtgctgagggactgaactgacttaaaagtggtacttaatgagagttgtactgagaaatattatggactgcaccaaccacattggcccaagagcttagaaaggacttttcttttggtttcctctggtttggtttcaatttgttcttacatatgctcagttcgagtccatacccctttatcttttctcctgcaagaatttttcctcatttatgtgctatgcagcctgggtaacccaagtcacaaccatacaaagcatttgtctgtgatgtacaccaagacctcaggttcaaaaatgagtcggttaggaagacaatggggtaagctacggtggcaccattgggtcacatctctttgattggtaatagtgtctgtgaatgccagcactcttcagcctacagcccaacttcttttctaaaataactgcttggccacagatttgttagaaaaaaaaaaaaaaagaagccagtctggctctgagctaggatcctgtcatgagctgtggtcatgtcttggcccactggccttctgctctaatcatagtaaaatctatgtccctatttgaggctcatggtgtccagtgtgtgcactttgcattttactcaagaaaaaaaaaccatagttagaggggtttctcagctctgtaatttaatccaaatactggtggaggccaggagaagaaaatcttggggtaagaatgtcccatcctctcagatatattctgttcacaatattttcatccttctggctcctccatcactaatctcactgtgggagacagcaggattcaagccctaagcagtattgacagctctagtggtggcttgccttctctgtctcatcatcttcacttcgccacacaaaggcagatttcatccagccctgtgtgagaccactcacctttgaccacaagtaataagttagaaaaatccactccaagttgaacccctttataaggctatgtcagcccttcttgttcaattaaaaacaaacaaacaaacaaacaaaaaacaaagaacttcagtctctgctgaattccactggcagtgtgccacggcaatgtccgggcaccccattcgggtgggtagtcggttgggtggtgtccatttgacagagtgaatagactcagagcagtggtgagagtgggcttttcattaaatatgagcagacgtgaaatggagagggtttgacaattagagatggcaggagaagggccctggaatcaaagtgagctcacatgggcagatcagattacttctcttacattctttagttgttctgaagatcattttgaattagtgtcagtggaaccatgatgggttttgccctttgtcttttacgccgtgcctgtattgtttcccaagacactcattaaaggtcattacactattacggggcttgctttggtcgcagggtttccagttgagccagttgcgctttggagactgcctaattcgttcccctcttgcctagactttccctctgcaattttttttttcaacttataaaggaaaggatttccgtttttaagggactttaaattgaaacacaaagccccattacatgttttctgaagtggtaagggaagtagctggttcccagaggtggtcatatattaacagtgtttacagggatttgaagacccgtcttctaagtgctgtttgacacacctctccttggaggcgtggcccatgacctaggaacagtccttgttaaggctggtgttaggaggccatttgtctaatattgtactcacaaggcaatgggaagccaagccattaataaggccttcagaggggaaggactaatttttacagatatttttgtttataagtatcatgagcctggggagatagcttggttggacttgatatgcaagcacaagaatcttgagtttggatcccagaacccacataaaaagccaggcatgatggttcatacctctaattccagcacttgctgggcgggtgaagaatgaaaacaggcagattcctgaatctcatttgtcatttaacctagccagattgattctcttcagatttaatgagagaccctgtctcacacatgcacacacacacacacacacacacacacacacacacacactaaccattcatccacaccccacacacacatacacccacacaaaactagggtggatagtgaccatagaggatgcataagctgaattgttcaatatttaagtctagactgggtattcatttctcaagactagaataaggttgcacactaaatctagatgaagtgctcagtctagaattacagcatcattttctgattatgtaggttttatttatacttcagacagtttgggcactgtgtcagctcccttcaaaaacaccaggatactatgcatttgacttcttcacaagtctctgttctagtacaggaaaaaaaaaaaaaaaaagagcaaacctcccaacgtaaaatctcatttgcgccaatatagatatagattttaatcagctccgctctgcccaatataactttgtgaaatggacattctctctctttggaagtttatccttgattccagttttgcctggtggtctggttgccaagtgtaatagaaagggacaattaaaattatgatgtagtgacaatgaaaggccctattgatttggacctgcctagacctgcctgatgtgattctggtgacagttcgtcagtaacgctggtgtaagcaaattaatcaagttgggagggggggggagaaaagcaggcctttgggtttgcactgggaactggtgttagctcaagcatacctgtgattcttcagaccatctttctctcactcactgggagtttacctgaacaattgcacagaggattcagaaaattactgaagctaattttaaactgtgcatgacttttccttcttgtacacagagatcacagtcattcagctcggatggttaggctgcgaggagcgacccaatcagattagctggaaaggagacacactaaagtcagtttagagtaatcgcgagtcttgccagatactaaactaaaccctgcttatcctcagtggtctttggtttgttcagggagagaattaacattgccaactgagctgaaggctttccatcaaactaatggcattttgaagaccataaaggcagatagatactagggcaagatactagaaacagctttaaagtcttccccaggtcacacctatgccaacagtcttcaaagccctggaagagacatgaggtttagcaagctgcatttaaacaccaccagtctgtaatcatagcatcaccttgatagacagtttggagggactccccaagtccccacctcctgagtcttcaatgttacacatttacttctgggacccaatgactcctcatcctgtcatcagtgaagaaacagggaaaaagaaatccagagggtacttggcatacaagttaattttagaatttcatgggtttttttttaattgatatatattgacggaaatgcataggatacaatgtgagttttccatgtgtgcagacatagtgtcaagatcttatcagcctaattagcatgtgcgtcacctcaaacatcatttctcgtgatgaaacctccacaatcttctctctagctgttttgaatgacacattctgagtatcatcacctggagagagcctgctagcccactgggctcaagagttccttctttccatttcattacaacttttgctcaatgactgcctcctccccgaacctctcatgcattctctttaagttcatgaatctgtgtctctaatgtctccctctgttttcatgcaactgtgccaatgttttcatatccattttcattctctctctctctacttccctcaaccctgtcacacacattggtagcaaacactaacagacccttttaattctcaggctcttcagccaaccttggccctacatcctgatttatttatttgcattgcgttgtgggaagtgacaataggataaggaagagaagtgggacctggctaccattttacccatcataagagaccaagattaacaatgttctcatgaagagactcttcaaatatagtcattgccccaagcaaggtcactgaagccaacatctcttgcttaatttccagtaggcacattgggcagagagttgactggaaagtttttctcttcaagtaaagagtcacctcacacacagtggtgagctgctagagtgagtaatgtctaaggcagaaatcaacctttgtcaataacctcctgggaaaataactcctgaaattaatgatcttcaaagaagaaccccaaacaaagcccattctcatccagtatgtgatgctggtgtttacaagtgccacgtcaaaggaagtaattggtttacagtaagaggtcctgcacctttcccttgccccccagacaaggttctgttgaatcccttaaagcaaataacctgtgacagtctactgggttcaaatggaagagaacgttacagtagactgaagagtcagtttcaaaggacattctctgacatgggattgagaaatgggaagtaaaaaggccagaatgagggaagaagaaaggacccattctatgtacactgtcacttagacatttccctttccaggagttccgtgctataaaaaataactctggctctttaacagcaaatgaagaaatacgttggcataggtacactagacagaggtccttattcaaggtgacatggaaattatgcttgcatctttattttaggacagtggccggctatcaggatactggtcttgacagctgtaaccacaaggcagtgggttcttcttacctccatggtggaggacagatggagccagctagcacaccatttctcctcctcctccactatcatgggcgacagatgccagagccagcctgctcttcacttaagccttcttgtcaaggctctgccttgagcccaaattctgacctttacttgatgaaataaattactgatgaacaagcagaggtttgaattagagcaggcttggagcaaatgtcaagcccgtctccctcctcctacctccaccaggagcatggattagaccaagtctggagtttccaatgccttaggctttatgggtctggggagatataacttattaacaaagagttattaaatttttatcaattttacaacacaatgtaaatgcctcctatgaatctacattgtattcattatcatttaaaacgttaattaagtcaaagttgcatttaatttctctctaaatgggcctctgggaagaggcttttagaaacatctgtgggagcaggcagctatggagccgggaagcccccagcctacattcaggagaagttccttgagctgattgctatggtgtgtctgcagctaatttgttatgatatgattgggcattgtctcaatctgacatcagactaacagtgggcaaagccagtcgagagagactgtgggctgtcgcactggcttctaggcatccttcctttagacactacctacatgggtggcacagttcatgtgtggcacctccgatctccattgcacattgggatttgcccatcatttaagctgtttagatcttcatctgagatagacagttgttgcctggctcagtcacattaggacattttctgtggcatgcacagaaaagatattcgtctttgatttccacttgagcccagaagtacaggtcactataaccctttggtaagaaaaggcacagtgagatttgatgaaaactagctttccggatttgaaccggcagtggtacccttagcttatgtgagcacagaacagcaatcctgcatgtctttacttctatacatagcgtgggggctaggtttgctacttggttaatttggataatgttccgactagatggtgatgtcactacactaagtctaaggtactctgccaaagcagcaagaatgggcagctgtgttgtttaatttgaaatgtatgtggtctttgcttcctgccttgcaggtgctactgctgtcggcagattctaattcacccctgctataggtagttagcactggctgcgggccaatgtagctgtaaactgaggcagctgtagtacacctcatctgtgtagtttcagtcatttgatgagaaagcagtggtaaagctgggatttgaatacaggttggtatggctccattttccctgggtaagttggggcacttagatctttgcattaatgaataaggttcataacccagttcatctctgtgggaagaaaaagagaagctcatggcagtgttggagctagatatgcacaatgtcagagtccttgaaaagcaagcagcctggggatccatcccataatcagccaccaaacccagacactagtgcatatgctggcaagattttgttgaaaggaccctgatatagctgtctctagtgaggctatgccagtgcctggcaaatacagaagtggatgctcacagtgatctataggatggaacaccgggcctgcagtggaggagctagagaaagaacccaaggagctgaagggctctgcaaccctataggtggaacaacaatatgaactaaccagtacccccagagcgcgtgtctcaagctgcatatgcagcagaagatggcctagtcggccatcattgggaagagaggccccttggttttgcaaactttatatgccctagtacaggggaatgccagggccaagaagtgggagtgggtaggtaggggagcaaggctggggtggggggaagggtataaggaatttttgggatagcatttgaaatgtaaataaagaaaatatctaattaaaaaagaaaactattaagaaaaaaaaaagcagccatgggcaaggcttgggattcattctgtagaatgtggggaaagaagaagagaagatgaaataggccttggtagaggccaggcaagggtgctgctcttaatattcagtgcaataggaagcacctaagatgtcagactggggaaacgaatcaacaggtccactgtagtgggttccataaagatcccaatcatggtgagatatctgagaaacccttctacacccccacaaaaaggaaaaggccagaggctgtgatgggaagagagtagaggagctctaaggaggttttgaagaaagccagcagggtcctctcagatgaaggccattaccaaatactagtccaagaaattgtggtttccttaaaaacaattaacagatcgagaagttggattccattttttagtgaaatttcctaagccaagttctcccaggctgactagcagctggtggaattcctttttttttttttttttttttttttttttttttttttttttttttttccttcccattttttattannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcagtgctcagagcactctctgctggcaagctctcttacagggaaggtgtgcagatatcttgtttttggacctcctcctggtcgaagaagaaggcccaaaacagggcctctctcagaagctgtgttgctttggcagttcccagaagctgtcagcttctgtggtgcagactctcacctgtgcagactaaaatcctaagttccagggagtcctggaaccaagatggtgaccgctgctcctgaggccgaggccgtctcccgagccaggcggacacctgtcctctggtccggatggtggccggttatctgcggcccgcccaggctgctgcctcagcggctctgtgcttctgcccgttccagaagctgtccggttctctggcacaccctctaacctgttcagactaatttcctagattctgctgagtcccggaaccaagatggcgaccgctgctgctgaggctgaggtcgcctcccaagccaggcggacacctgtcctctggtccggatggtggccggttatctgcggcccgccccggctgctgcctcagcggctctgtgcttccgcccgttccagaagctgtccggttctctggtgcaccctctaacctgttcagactaatttcctaagttctgcggagtcccggaaccaagatggcgactgctgctgctgaggctgaggccgcctcccaagccaggcggacacctgtcctctggtccggatggtggccggttgtctgctgcccgcccaggctgctgcctcagcggctctgtgcttccgcccgtcccagaagctgtccggttctctggtgcaccctctaacctgttcagactaatttcctaggtcccgcggagtcccggaacccagatggcgaccgctcgctggtggaattcctacttgagatttttggagttttctttaggggaggggcatttacatagtttggcaagaattggagacctacctggctgtgctccatctatttccttttcttacccagtatttctttctccatacaccatttttcccaattgaataaaccttgagcgtgttgaaggtgacagaggtggtcagctcaagggctgttgtgatagtattggcttaggcagagcattggacaaatgaggccaccaactgggacacatgaccagcccctaagggtcctggcttcaacagtgtgtggtagcttcagttccagatcatggaaattatttttgaacatctcttagtatggcagggatgctttccccctcccatctctctcagggagacaatgtctccttccatctacagaatctacagagggggggaaataataagtaattcactgcctgctcactaaaacccactgcagttttcaactgcttaccctactccaggggaaacatgaaacacatttcctgtgaggtacacacacacacacacacacacacacacacacacacacacacacacagagagagagagagagagagagagagagagagagagagagagagagagagaatcatgtagcatttctaaggattgtggcacagttttcttttccattttgcttctttctgcataaacccctttcctccctctgtattcattgtccacatctatacctgtgacatttatgtgcaccgtcaaccctaaaggttcactaaaacagcatagaaaagctctgtgccttggatttccccattatggtaggctgtacgtgctaaggatgccaacttccggaagtagaatgtagctgagtgcacttgaccatctagctgtctgctagcttccactctctagggttttccctttaaccagtaggctaagccaggtgatcctccatttgctacaagagttctgcttctcctctaaacaaagtctgcaaagacagacagaatgaaggcagccattttcaaaacactggggactggagaaacctctttgtgtgtctagatagtgcctgttttgaaggtagatttctacatgtatgcagagtcttgtgaggaagcaggtttcttatgatcagcttagaagggctgggctaaaccaaagttggcctccccccatgcannnnnnnnnnnnnnnnnnnnctctccctccctccctcccttccttcctcccttccttttgaccatttcatttgatcatcattggtaggtacatttctctcacatccaaggacaacagtacaaggtacaaacaaattctcttggcatcttctagttagctaggaagaacctgtcctagcccctttaaacagaatgtgagtgccaatcatcccctcggctacagtggaaatactatacaaactaaaagtgaactcttaaggcccatccatctcaggattggtcacctctcatgacttttaaatgaagtaagaaaattcctgcttcagaactagaactataccagctgtgtggatgatgacagaggggccagagctgtgccagaaatatagatagtgactggagcatttatagacagaggcacatgaaccatcctttgggagcagtgttctttacatggcctaacattagctttctgggctggaacctgttggatcttattcgatcaagaatggacttaggggctgccttccgtccgtacatggtcagaagtgtagcagtctggtgtcaccgacttggcatcttgtactggcaggaacacgtgtagaaaatggcctgaaggattccagttcagtaaaaatttcatgagtaaaatataaatagatgaagggattctccaccattgaaggggtagatggcatgcagaaacaggctcaccgcagattaatggagttcccctaaaggtctctgagcagcttaccatagagcatgtctgtgcacaggtaagagctagaatgcccaaggaacttaagaggggaaatggaataaggaactaatttaggcgtaacttgaaagtcatcaacttatgtgtacagtcagcattctttgtggaggttaagtcctgggatagaagatctagaaatgacgcatagggataaacaacaacaacaacaacaaatgggtaggcaaagatccagttacttttttttttttcttaaagtcaagagaggtgaggatcctaccatttatagagcacacattctagaagaccagggacttgtgatgctccatttagttttattaatttcagtggatccgaatgtttttcgtaggagtcagggtggacaaaataaagcagaaagggtcagcatataaacagaggctcactttgggaaggtgtcactatcttcagacagatgtccctacctggccaagggaacaaacatttgggactcttcaagacttcaggggaggtaggcagatctaatctaccatcagcacttagatcatacttttattccctctctggagacttcacaggccagatgcttacacctactctctgtgagagctgttatttgacttcactctactcaagacaagcaagggacatgctacactcagaagtgagataatacctccagcgtgaacgcttccaagccagcaccatgagcaggcattacttcaaaaggaggtagagtgagtgacctgccatgaaaaaacaggaggtggaaatgcatctatgaagtattctagaatatatgcaagggcaaaggaattgtaatgtggttagcatcacacaggcagacatcttctgtatcttccaattacagtcaaggtgggaattcttggggctctttactattcagtgagaacttctcactgacaattgaaattggaaatccgaggaaccttagagcaggggaagatacgtgaagggtacaatctgtggagtgctgttttgtgtggtgggggactttgaagtaagtcccattgtgatcctgttttaatatggtcatcaagtatcaacttagcagatgctgattgctgcagtaagaacagtgttgtatgagggtatgaaacatgatacttctcaagacaatgatatttcatctgggcagtttcagaatagacatcatctatttctgccctgggtctctaaataatttccggaacgactttccccatctgtatgatgaagttaataataggacttatctctggggctgcaaggaaagtcataggtgcagagcatgcacacacatgcacacacacacacactctctctgtctctctctgtctctctctgtctctctgtctctctctctctgttacatgactaccttgcacatgttgagtattatgatctattattgttattatcatcattcattaacacatgaaaagatgaacttgactgaaatcacatagtgagtgagtagatgcttagatcgaaagaacaccatccttcatggtatggatgggaataatgataagtaggcactttgactatagctaatgcatttctttttcacatgatggagtcttgtccagctagcctcatgaaaggaccaatcaattatagcagagacagcccatggatgggagctgagagttgaaaagcttagcatgacaggctataaaattaaaatagaatcaattcacttaatttccagatcaaggaataatagtctcaacagaaataagcttacaaaagctgtctccctaggacgttgctttccatcttgaataccctgaaatcttggtcatatttgtataaaataaaagaatcagaagatatgatctctaacatcccttgaaatcctgaaactcccattctctattttttctcactgaagcttttggatttttttaaaatttcaattcttactggcataaatctttccataatgccgaagtctgcctaccaacgttctaatgaacgaacctgttgagggaaaaagaatgaaattatttgagtactgaaagtattgagtacctgcttggttgttgctctgaagttgggtccttggcctatggccaggtgccaagattgagaatgcccggaggactgcactttgtgatgggctcattctgaagccccaccctttgaggaaggctgaacagagaagtatgcctccatcatgggcttatctaaagcccggggacttgagggttatcaatcatcataccacacaaccagtgcccagcctttacataatgaatggctgccagcaagtgtccttcacagccatgctagctgtgccatattttgtttcctcccagtgttcattctagaacataatctgtggaagtttgaggggtgcaaaacaaaggcacatatctctaggccaaaagcctttttctatactggaaggtatgtgtctgataagtgccctggcaagccatgccaccgggatactggcagaggatctttaggtacttaaatgttcagtaaaatgtgactctgggtctcctcctttctggtcacactagagccctgtctctgtggcttttccacctctaagatgggtctggagagtcagtaaattcaatatgcttttggaagctgaatggaagatcagagaggagactagagagggacagacagggcagggcagatctttgttttcagatttctgtgagttcattttcaagatgtttctttgcctctgtgcaattgtgataacagttggtatagaggcttcatgccaccaccatcctctggtttgctctggctctctctgcccctcgttgaagttcttggtagagataatattgctacacctttacctgtgccttacactgttccctttgagtagacctgacataaagataggactattagttgagtagattatctgcacacattttgaaactgtaaatatacatactgtcttgctctctcatatattctagcaatagctgatttggcctttgggccatatttcataagctgtcaccattgttagggggcaatgagagctaacaacctcaaggctcagtctttcttgcttgatctaccagtatttccctcctgctggtcttcctcatcccagaccacaactgtattagatagcatagtatagtacaatatttattaatgtattatttggccatatttgaaattgaacccaggacctaacttatgctgggcaaatagtttatccctaaactaaatacccataccccagtcttattattttaaagtacaaacgcataattgttgacatctcattttaaagaaggagaagatgatgaacatttgtgttgttctcttggtttctaaaactcactatgtagttcagattggtcttgtactcttagcaacccccctgtgttggcctcaagggtactgggattataggtctgagtcaccaggcccagctattaaaaaaaatcttttgatgactttcctgacaaccagtaacttgtcacgttaggaagatctctagctttcacttatcaatgtggcattgagactccttcacagtttggtctcaatgggcttctgtagttagagttttacagacatttttttctaggtttcttccaaaacagttcttctgatgtatacattgatgtgatatttccctgtgacttattctttccctagcttcttcaaggtaattaaaacttacctatcagtaacccaggcccaaaggtccaatctggcccttcaccttctttcatgggtgaacttccacttcaatgcagctaccctcattcattcacctactgtccctggctacatttgggggtcacagcaaagtggagtagttccaacaaaatttggttcctgaacaccaaaatacttaccatctaactctatcagggagactttagctgacgctgatttcacagttcagttttcaagtatcgccagctctggcaagctgtcttggctggctgtacccaagcctcaagtcagaattggtaagtctcctctgaaagcctgcaaaagcccagagaaacccaatgcagggtagctttcatgagtttttatagaaacgagtggtccttgaactctggtcatacagcacaccatagccaagaatagtagaaattcagcagacactttgggagtgacatggaaactgtcaagaatatgtctttatggttcattgagcgtatgtttcttcatgcttccttatattgtcgtgaagaatgtaattgtggctgaatagctggttctttaggccactggacaactcttagatcattctagaactgatctctgcttcttgtgaatggaacacagctctctgattctttctgctgacagtcatgtggtgtttgaattctgtggttgatctaaagatgctgctgtcttcccttccttgtttgtcattcggttgcctgagtctttgtgggtagagacgtatattggaaaggcgagatttcactacttccaggatgatgtcctgctgaggtccttccaatccagacttcagcttcctaatgcaaacatgctgattttatctacctgttattcctcattgatttttattcatccacttttctcctaaggaagggtttgctccagctgtagctagttgcctagactactggcttatccctctgtctacgtagagtcaactcacagcttaaatcttgagagctcaggatccctttagaacccccacccacccactttttctatttttccaccccttctgggaactccaatggtaactctgtattgccagggcatgtggcagacaaatgccaccatttcccaatgtttatgatcttcctggccaaattcccatgtagctggtgggagcgactatgtgctcaagtgaggtcctccgacccttgatcctcttgatccaagtgtcttactcagatcatggggaggatgtaaagcaattttttagacagacaccattgcttttaatgttgatatggcaaagtctgaattataaataccttccatctataagatgttatattgttttacatggtgatgaggaagttgtggggaagatatgtcactgatgctgtgggcagagaaacactacctgtcattttttctgggggtggggtagggaagatcaccgagacgtgatagcaaaggaacgcaattaaggtgtttcaatgctaaatcaaggaggaataatcggtagataaaatcagcgtgtttgtgttaggaagctgaagtctggattgggaggacctcagcatgacatcttcctggaagtactgaaatcttgcctttccaatatacttccctacccacaaagactcatataggtgttgagagccacccttttggttgttgcctgagctatttttgcagttcttagagattaaatctcaataactttttgaaattagagtgtgtttctctcggccgagtgggtcataatgttcttctgcttccttggcacccaaagaacagttctgccctcccctaaaccccagagcattatcatgtgatagtgtggcttgagataagatcagggtcgacagaggaattgtcatttttcatttcttgggcccctttgatcccatttggggtttatattttctgagtgaaaatacaaaccctattgcattcttctgtcctttagagtcttttattattcttatttttccccctgttagagatctaatccgagtcttaagtggcgtggccattagttatcaccaccagattcacagcctacctgcactttagttctcttactactgaacagaaacctcccctgatgcacagcaactgctggctgtggagctaccatccgcatctcatgggtacttggtgttaatttatttcacagtttcctttgcagatataatcagacacactatcacatcccggcttctcctctttattgtgttcctttgctatcacgtcgtctcggtgatctcccccccccccccagagaaaatgacaggtagtgtttctctgcccacagtatcggtgacatatcttccccacaacttcctcatcaccatgcaaaaccatataacatcttatagatggaaggtatttatataaacgcctataaggtatttataattcagactttgctatatcaacatatttcccaaatggcattgtggtcaaggaacttgttctccaaaaatggggggagtggggagggggaggagagaatgttcttttctttctcaattgtaaataaaggagaagttaataaggggaagccttgcccctgattcctccatattttgaaatgcgcgttgtgaatctcatgttaaatgatcagttgtattaatagcacactgttagaacaaaaaggagctctctctgttgatgtatttgggtatttactgggtgagttacagagctttgtgtattagaattggtttgtcaacaattagcatgctaggtttttatataacctatacttcaggtaacagaagattattaaacttcaaccagtgggttagaaatctgctgacgggcaataaaattcttacgtataacagcgctggagaactgcagttgtacagctgcacattgaggcttagattgtgagatagatggcctcagatcagggggacttgaaatatgaagtaaccagaaggtggcactgcaaccctataaatgaaatgctccctcccagatggcctctaaatgcctatcctcctgcctcacttcctgccttttctctttctcttgattctcctttatttctctaagatggatatctgaaactctttttgcaagagatatgcatccattaaaacaacacctctcaacttgcgatatttcttttaaatccaatttgcccagtctaatgctcacttggagaaagttccagctaagtaaacattcactgaatttaaaagacaaagacccagaaagcagagtcagcctccagttgcctccccaccaccctcccgctgttgctgagtggaatggccatgtctttaatctattggttatacaggttaattcccacagtacccatcaggatatggagggcatgtttataaagttaataaatagactggattaatatccgtctgaaaataattccaacttgatgctgtctcacaaagaattaccaagttagaatccatgttcaccaatgggtgttgcttttctctatggggccagaagtcagtcctgacacatggcataagggtttatttttatgtcttgttttagatttcagtaaaattatttttagaaaaagtgatttgtttttcaacctgggcattatcaatgagccaaataagactaccaaaataaatattaaatactttttaaaaacataactataggcaacaactgtttatttcttctatctatatgtatagcctattttcaaatttattttttaaaccaaagatacatctttaaaaaaaaaaaaagaaagaaagaaaaagaaaagtacaacatgtgataaatactgccttgtttacgagacagacatttttattgagagaataatttacctattttctttagtattctacctgttagtaacttggaagatatactttacttatgttgtaaatgaataataattttaattcattaactttgagcgtccattaggacatttctgtgctgggcttttgaaacttccaggtataagtggtgggcgctggccagtgctggacactctttgccttgcctgtgtggtttacaaagtgttattaatccgaccaaaccacacagcacatggtggggaagcagttccctgtccaggactctacttccaagaactgattttgttgacaatgacttttcagaaaacaattgtcattagttttcagtaaaagctggtccctgctggcctcccttccagatctctgcccagacgacaggaaacaacaagctgagagtcaaggataggttgatcactcagtaagacatcagcttcctataacccacagaacccttctccaagaggttcagtaactttatcttgccatcagttcccctgctcgggataagaaatgtccatggcagacccctgcacttaggttgtatgcgcttctaatatgtcttatcttggacaaagttataagtgtaactttgtagcagcctgaaggaaattgggctgagctaggcagggtttcatcattttctccaacgagtttacttcccacccaccagaataaaggggaaaaaagtttaagatgatctgacttgctcaggtattgtccaaagtctgtcattcgggatgtgaagttttatagcatgtatctatccaagactctttagctgtgtgctcaggtaccctggttgttccattcacagtgatcctcttagaatccttatattagtattttcaaggtctttgctttactcgttgcttccaccctctggtctctccacactttattattgcccatttctacattattctcaactgtgtgtatccgcagaggaccatgatctttgggcacacagaaacccaggctggtatgtcttcccatctcattcttgtctctaaacttattttctgtgaaggtcccactgggtaagactgactgtctggggtgtgtattgatctctgatgtgacattgtcatataattcttttgtatggctaggtttatataacttgtgtattacatatttgagggtaaatctgtcttgtttatctagcttaacttgtcattctcatttttttgatgtcttttggagatttaaaaggaaagtacaagaaaaagcaaagtcctgaggtttcatttaattattactttatttacttatttattgcttcattcattcatgtatgtatatatgtatgcatgtatgtatagaatgttgggaattgaacctaggaactcgtgtttgctagacagttattctactcttgaacttcatcctcagcccagttttcccaaggttttggttgaatagacaggcatgagactcaaacattggcattctacaaatttccctggttcatttccttggaagccagaactttaatcgccaaagcaaatcagattttccctggcacagcagtctttttttttttttttttttttttccttttgtaaccttctaggtggagtctggtaggaagtattagagagttattttgtggctggctagttatgtggcctttagtcaatggctggctccaattatatttcccacataataggagacagcgttcaggctcaaatcatcactgagcagagctgggaaggtcttacatttaatgaattccaacctcctaggatgggaagtgtcttgctgatgccgcacatgagatctaggccttggatcaagaagccagggctcctgaccacgagaccctttcctttactctgccaagcttgatctagccactaggatcaatttactagtaaacctcaccaggggctcaagtctgtgggagagtcatcgatgtgtgaggtgtgtgtaacgacattagagggacttcaaagtctagttggggacacattagagcaggaaataagttaataacagaactaactaaggagatgacagggagtaatatgagaagagccaagaaagtcttaaagaagacagtctacctcatttaggaacgtttttctggaaagggagagggtagcttgtttcttgaaggctcagtagactaatacattgggaaggaggtatcacctcccccatcccattacttaactaccctgccaatgtatgtctatcatctcatggcccccccaccagaaatccaggaaaaagagccccttacagtcagacagcacacgtttcctgtaatttagagggaacagtggggtttctccatgtttcttcacatctgagtttcatttgtcacagcctcctcaagtggagcccattgaaaagttttttggcttgctttgttttatgacacttagcaaacctaattacttggcctgaacagttcactggggccacacaaatatggctcaaaggccactgttgaataatgcaaaggatgagggtggtacaggacaccaaactcattctcccagttggacaaaggatcagttgcctacgggaggcagaaagagaataggagccaatttaaatagagtgctgagccattaaaggacaatagacaggcaatgtggaggatcccataacagacttccaaattattcctcaagtcaagaaaacagttgtggagaaagtttagcaagagtgtaacaaggggactcatcaatgcactttttacagtttccatccattttcagaatatcactaggacctaagtacttggactgttcacattacataggaaagccaattggaattttgtaagcctccaatgtgtaggtttgaagccagtagggtgctttccaatcctggtacatagctcctaccctccttgccacacagtatcaactgacaattggagacatagcatgccataagaatttgccctatcttgggagtattgtgcttaaacaaaggctaatgaggactgcctgccttgtgaagccagggactatatacagcagtgggggatttgtccagttgcggaacccatatcctgtgagacaacagactttcctagaatgaatacctggtttcctgcaagatttttaaatgtagttagaaatccatggttttgtgggtaaatttctggctgaaaaaaaacaaaacaaaacaaaacaaaaaacaaaacaaaacaaaacaaaacaaacaaacaaaaaaaaactgtcccctacagaattccctggattagcaggatggagttaagcagagcttaccagtgactccatttgtttgtcaggctattaccttgtgatctctgcatcacagggcatctgatctctcagatctctagaaagaaaaacaatagatcttataatgcccagtaattctgaaaccagaaccccaaagaggcctagaacactgtgaaaatggctccatttgtagagttcttatgatgtaagcatgacgcatgacaatagaagtacactccccagaacctgcctcagaagtcccatgtgctgctatgtacctgtaatcccagcattgcaagagcaggcataggacatgttgctagtcagcttagtctagccatatcattgaacttcaaagattaaggtgagagagattgaaaaagacagttaatgctgacctctggcctgcacatgtgcgcactcacacacacacacacacacacacacacacacacacacacacacacacacacactgttaagacttccaagatcccctatcatctaattctcctttatgggtggggttctggtggctaatgatctgagttcagtgagcagacctaagctctgcttctggctttgatttttagtgtagtcttgaacccaaagaagatgagaccagagcactttggaacccttcaagccgaaggatctacaccccacagcttcttttcacagtgtgctgagcaaggaacccactgcacacttgtattcttaaaatgctgcacaggatatatccggacaataaattatagtagagatggattctgagctgaccattcagcactgtctttagaaggttactatgtccttaagaaacataccatactaaatgttgtgtttagtgtaaaatcacaatcccaactgtgccttgcctcccaaggttaaaagcatcccatatttctaaagggctctgtcaggacatttttcactgggtacctgggttgcactaaaaaatccatgcattttgcttttatcagagtttcagagaaatatcgtgttaaccatctggaatacatattagaattctagggcccttgacacaatggactccacagcagatatggtgtttatggatgacctgataatggtaatattaatgatctttatttatataatacatggtttagaaaacagctctatgtagacacagttggattcggggctggtctttagaaggcagaatcagcccaccaagcactaattttaacaacagaaatagcagagtgaaaacggaaataaaagtatgattgacatctgctactcatattcatgtgaagctgtttagcggggagggggaaaacaggaagagggtgagatatcagttaaagcatacgagctaataggaactcgcaacccaaactgaaaatgtaaaccagcatagcagtaactgggagcggtggatgtggggttgcactgatgtctgcaagagttctgacaccctctcacttttttgtttctcaccctgggcaggtggcaagactcaggttccaaggcagcatgatcctttctccactcctctggctatctgacaatttgtaaacccaggaggaagcctgtgttgcacaggctgtccttagcaatctcatgcacacagtgtgaagtgatccaaagaaataagccactggttgtttacctcatagcattctgtggggtggtgggaacagccactcgaatgaatgcccttgagaaatgcgcagggccagggtagggagagggtgcagtcagttttaagagcatatctggaatctcagaagtcaagaacgtcatctaatatctttaaataatgaaaatagaggaaagatcataatgaacgaaatctcatctttttgaaaggatgacctagtaaacaaggtttaatgccagtgtttagccttggaatctaacagggaggaaaccaaaatgggcagcagtaagctgggagcttcacttacccatgtgagtccttttaaggtgcagagagcagtggctggcaccttaacaggggttttcctcatgatgatataaatgaaacctacacagtaataaataaggcatactagaaggaagtttgttttcaggtaccccacattctgttacatttctttatgtctttgttaaatgtttgagctgagaattgccaccctgacatttacaatgatggttttagacaggaggctcaaaaatatcagcactaaccttaaaataagtaagtaagtaagtaagtaaataaataaataaataaataaacaaggatgcttgtatattccacgtcatcactctgtacgctccagctgatgattttattaaggatgcagcaggaaggaaagaatcaaggataattataaattcataaatacataattcattggcatgagatgattttaatgggatggatgctgggttgtctctttcttcaagaaaataacgtcagtgctctgattaaagcccataatctggcctctatgaaatacttgccaaactgatggggtgcattttcttctctgaaaccatctttgataagaaacgcattacaaactcatcagtttggcttcctgttaacaaagagacagcagccgtctggatcattctggattctcagtgaaactgccatcccatgtatcccacaactaacgctatgccagtttgacaaggggcagacgaatccaggagttactatgcgggggtttaaatctatgcggcagctgacggttgaaataatcatctgtatatggctctgagctagccggggaaaggttgaagctgtatattttcagcatatctactctaatggttaatctgttgtcttgtacagggctctcacagggtggacctgcagcacatcctgacagcttagaggaattactcatagaggatgggctttcgccttgactctcagagtatcccggtagatgaatttaagttcgcttgattgaaaaaggtggaactcacctgactcaggtcctcaaaacatgaagggaccaatagggcccatagcaggttgggtcatagggacagtagtgtcacgaaatgacctctatctgcccccaagtcctcagactgtgtgcttcaatataataggactctgacccattgtattgcttgcctgtttgggcaagtgggaaagtatagtgccttttggaaaggtcagaagctggacagatgtgcagaggagcctgctgaaggcatcaacacagattttctgccaagggtcagctggttaatatctttagctttgtaggctatatggtctctattgaagttatgaagttgctcaatattgatatagaagaaaagatgctagggacaacagggaaataaatgttggtggctctggtcacatgtaattttatttatagagactaaaactcgaattttgttttgttttgttcttggtattctcagtagaatccaggtcagccccaaaccctaatcctcctgcctcagcctttgaagtgctgagattacataccttcccatgcctcctagctaacaccattttaatgttttaggaaatattagccttatagcttttaccaatcattaaacaattgtgggctatacaaaagcacatgggaggccactgttgaccctggttatgaagagtcatgagaagaaggcagcttctggtgccaggagctgagcagacttcatccatgctctaaatgacctaaaaacacaaccatcgcacagtagggcttcaaacaaaaaaaaaatcaattctacctttggcctgcaggccttcccatctggttggcttgaggaagaatgtggtgggggtggagggtggggtggggtgggagatggtgattagggttgagctgggtttttttgagttctgtttaagtcctgccctagtttggttcaaatgaattaaaagtggtcttcttgctccggtagccctctttagactcgcctagaatcactcagggatgttcttgcatttctcatttcacttgtatgctcctcccccaattctattgttcatgtctgggtctttttgctgagagggtaacacctaggattttcacctgagcctccactgtactggaggcaatagagaagcctattctaaggtgaaaaaataaaaaagaaggaaaagggccaaaggcaactagatgtcctaaaggagtgcatagtgatgggcaagtacagcagggtcagagttcagggaagataaatgacccgagattctagatgcaatccaattggatggaatttgtgggtaccatgggaatacacagtctatctagtttgattctagaggagtctttattcctatttatagaaagaaattacagtgaaggtcacatggatcctgttaacatattcatgtagttttttttttctctctctcgtgtaggagctgaattcttccattactctatattgatggactcaaacttacataattcaggtttcctaggcattgaatagagccagaaatataccctgtgattaacttctacataacctattgttccttaaagtctcctttcctattcttctattagcactacaaaagccagaaatggaaaatcaccaacaaaccctcccctttctgtcctactagctctccacggggcgggtgcgccctgtgccatgttagtacaatatagccgcccattttcattttatataatgacagattcctttaataacctacgccctccgagctttacaaataaatctgtttcctgttttttcagctacaggttgtgagatttcccagctggataacgtacaggaagacgtgactgttcaattttagggagttttgtatgtttgagacagtatggtggtggggtaacatccttcatcttgtcattatttgtacactaatatcttgccatgatctttcacaaccactttccttgattgatcttagtaaggggactgtgaagaattcttggatactatatcccctgaatgtcagatcagaaattctcatcctaaggatgacttctctatgtcccccaccctttgtcttagccatgcttagtgcccagtctcattgattgactcatggcaattcctagctacaggcatcatccttcatcaacaggtactagcatagacagttatggtacccacccatactatgggttatctgtctggaatttattatcattgcttttcagtcatttctaaaggaccaccacttcctgttaccagcctgtgtatatatgacaggatgctgggggtgggggtggggcatccttctctcatttaggatccattttcccctggtgtccacattataaagacccaaagtgttaattagtccagactccttgatggagaacaggcctttacatttctcagggactccagtcagtcaaggaccttttgtccacatgactctctctgcagaatgacaatgtcaccgggacttctgtggtctgtcttggaggagaggaaaggaagcatgctattattaaccttgacaacagcaattgtgcggtcactgtttgtcctcagtgtttgccagagagcagctgtagatcaaacaggaccactctagaaagtacttgtgtctctctgatggaactgatggtacagatggctcagggaaacgtggcacatcacaatctccccctttctagtgatgctggggctagaacccaggccatcactcatgctaagcaagcactctacctctgagctctgccctgaatgatccggccacactactctttctgagtgtccaatgcatgacatttagatttaaaccaagctgagcagtggtatcaaaaccaagatggctgatcgggccttccatagtttaatactgagggataaagacatgaaacatgaacagtattgagcaggactttctccagtactttccagaagataatctgcctgatcctgctaagatattagttttggggtatgtgtgtgtgtgcattgtaggagagaagaggagctctatatacttttagaaatttctgcataaaggagaatgtcttctttaagttttacatgtcacccctccagagagtattttagatggacacttgaggggtgggggtggggaaaatctgccattcagccacaagggagaaacttccattctaacacaaaatgatggttgtatttaatgttaaaaaacagtgggtaacttttgtaatgaacaatttcattcgggattaatttcaattttcttctctccttattgtttggcagtcaaggttgaagctagagcccgctatcacaaagacccatttatgcacaagaatgcgactcccaattctccacacgtgcccaagccaggtgaaggagtgctgggctttgtcccagtgtttaacagttgcctggtacccctcagcgtttcactgtaacacactaagctcagttgcagaagacagagagctactgtggctttcagcatgcatttaacttctttgggccacaaaatttgaaagagaaaagccattaaaaaaaaaaaaacaaccaaaaaacaaaaccaatggatgatcatgaaaacaaccccactctccgactagcagcttgcaccctgacttcagtaggaagccccttcagtttgatgcctttgtgttcaataccactatgcatgccatttattctaagtgactccagtgtgaatatgacattactaatgatctgctaagtgtgtgcagatgtgggttactccagatgtggtcattaataacgtaatggagatagctgtttgactcatgtttatgagttgttaccttttattacttttctgagtttatttgctttgagctattttttaactccagccaacaaactcacctttaaatctcagagcttcatctccaccccaccccactctgccctccttaatctcttggggaaaacagggaggagggaaaatgcccggggctggaggggactggtggattcattccatgtaagtaacaggctacttgggcaacctgaaagtcacagtcattacccactccacctcacggatccttacaagaagcgccagtggtctctggcataatacttgcagtctggagaggaagacaaaggcaggggttgctttaaaaaaaaatcttgtaaaatatctgatcattttgaagtaagccccagcccccggccaatgtttctggaagacgttgctttgctcttgcttaaaaacagaacgctgatgtgaaggagagcgaaatgttgttacagatgttcagctctgcattaaggctgttggaattaccaccacatcttaaatcaattcccagagcattgtctggaggttatgtcaccgaaataatgaatcctctttagtcaagaaaacgcaaacatgttaaaacatcattgtaagtttaaattaaactccagcgccaacgaggggatctgaagcctcattagacctgcctgacattttcctaacgctgactcttctccccaaactgtaaaactgttagattcagggcctattagacaagagagcgctgggaagttacaacagaacattaagtgttatacttagggatgcgcaaaaacaagcccttgaattttacgagggctcaaagacttgggagagtttggctcctataaaaattccacattagattctcgaacttgtttgtgttttaaagaagctggcaagtcaggtttctttaaaggaacacctcttcattcagctcgtgtggaggcatgggaagatgctagaaaggtagattgcaatgagccagaaagcaggttaagttcaagcctgtgactctttgtgctcccaaggcagtggctcgctgctgcttgaacatgtttgtctttcgtgaaagcgagtgagcttaagtctctcttttgttttcatttctcatgtagtcatagaagccatgagataagaattatatctgagagatcagctacttttcctagaactgctttctgtaaatatgcagacattggtaaaacccaaagagaggataattaaatatattttctgtccctctttgtaaagagaacgtatccttgatcttcctgtgcgacctgagccatgtgaaatgctctccgttacgcagcattcgtatatttaagccggggacattttccatcccagctcttcagggaacagatttccaggctccgagtaaagctttgaacacagttccattgaagtgaacaaatcccagtctaaatgtgctatgattatgatggatgatctctcagactcacaatgaaaataaatagtctcctcgcatcgaagcaggcattagactccctccacaacgaggtgtctccccagagctggcgaacacatattaacttgcagatctcacatctgaggagccatgccagccaacagcagtgactggataaaagggaaatgtgtgcttaaccaaagagggtactttatgagaggcctggagctaatggggaagaaaaagttaagcaaaagaagccagcagaacagccagtgtgagggacgaatagagaccctttccacaatttgccacaaccatggtaatatgcagggttctcaggtaaacccagccgttgtcaactaggctggatgaaagaccttttgggatgttgcactgtgagctcatgaaaggaaaagtatagtttgtacctcccaataaacatcctcatgaactcacataaaaactcactgaagtggtgtactagcagccccccaggtcccacagttgcagtgcaatggtggccccacacactaaaagatatacccttgtattatgcgaaggaccaatgtgagacttccttctgcagcctaagccagaaaaatgcaaaagtatacctaggcacatgtgtgagcacgtgcacacacactcacacttcatctggcctccaattgctttggttgcctacctcctgtcctctgaaagaaagatgaattcaggtcaaacccagagtgcctgtttgccagctgagagatgcatatcaaccctaagtgtttttttttttttttcaataccatttatgtggcttgtatttatttcctttaatcttttaagtgctgtttagtctcggtgtgatttgctgtggatactcatttctgataagatgtgatatcctcccagccacatagtcccagcctggagcgctaagtgactgatagggtctcagcctgagtggagcctagggtgggaggtgggggtgggagtgtagtatggagcaggtgggagagagcctggggttgggagcctttgcacagcctttctgcctttctcaccttgacacaccattttccctttgccttgggtcagtcagaatgaggtaaccccaaattgacagtagaaaaagctactcctaaagaagtgggagattctgggctggtgagatggctcagtgggtaagagcacccgaactgctcttccgaaggtcaggagttcaaatcccagcaaccacatggtggctcacaaccatccataacaagatctgactccctcttctggagtgtctgaggacagctacagtgtatttacatataataaataaataaatatttaaaaaaaaacaaaagtgggagattctgaagccgatctggagtatgcttagattgttcgaatacctgtggtgctgtgtgtcctaaccgcctatgtttatttagggttttcagggaagcactgtaagatgcatgttctgttatgggtcttctggacaatagcaagcagctgagctggcctagccaccctccccaccctcatctaagcctcatacatgttaacatataccaagcttcttttgatgttgtcgctactaatggttctcttcttagctttaaggtaacttccatgcattccgagtttcagggctgtttcctcctagtctgtgtgacaatcaactctaagaatctgaggatcctagatctccttctcagcatcacagctttagcctggactgtgtgggggtggggagagcaggactggaattttatggcacatgcccctggaagacaggctgcgcaaagatgctgattatccagcatctctctttacaaaccaagcatggtgcgggctaatccatctccagcagttattagcgggtagctttggacaagagcagcagactctactgctctgtcttgtctgtgagtgaagcttcaccttgcttagtggcctgtgtggtttagacatttggaaagcagtctatggtttccagcccctcctctccaccaccctctatccccatccgccatatcattaagaggcatcattcagtagccacctcttccttcatgccaatgttcttcaccagcaccaagtaccctccctggcacagcggcagggaggagagctgagctggcctgggaactcttgagcctacatgcactagtgttcctggcccattgggaaccatgggcaaccaaggcctgggatttctgcctttcctcaagattcttgctgtaggtgcaaggattgggaaccagttaagatggttcatttggaaaggcggcaggctggcatttaatctgcttcctcaaatacaacgctgtttctgattttggttacaagaaaattcatttcaattgttcaaccaagcaaagtattaactcttaaccaaaattaactcaagaataatgacgtgatttttttgtgtgtagataaatcattatttcttaccttccttaatatgccagggcatttatatattgttctagtctgtttacagtgcatgctcaagggttggagcataaagcaatattgcttcaacctcctctcagctggtctcactgactaacgcatccagtctttgtcatggggcctctaaagacagccctgcctttctagtgagtgactgagccttgaatgtgtgtcctttgatatcttgcctgtgtttcgcagtctgccctcaaactgttcataatctcacaagctgcctgtatttgcagttgaagatgagcagccgccaaccctgtcaccaaaaaaaaaacaacgtaatgggggcatgaggaactcgcccaacacctccccgaagctgatgaggtaagcaggcccccctcaaccccggcatggtcacttccccagctccttcactggcttccccacctgcccaagcccaggcccagacctccctccctactcagctccatggggggaggggagccagatcgttagatggcttcttaaaggctggagtatttattctgtcagcttgtcagcagttaatgatagagctgaaaaaattctgtcacgaaaaacagtttgaaaagctgtttgaaaaatacataggctttaaagtcttagctgtcaccatgtcctgtctgtgtgtagttactaaacagcagtggcactaatgacgctgggagccaatcagagggactctgtggttagtttgcctgcggcaagactctttctgctggagtccctctgaggactggtttctgtacttaaggccatatgtgagatgtatcatcacaataaaaaatgaacctgaagattaccttccttttatcctgtcaatggaaatcaaatttctgctaattgattttgactgagaaaaaaaaaagtttaataatctgtgggcttgccaaagcaaagttcagaagcaatccagttctgcttaggttaaaagcaatattaattatggagctgggtgtgcttcttccttcctctttccttcctccctcccttccttccttccttccttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagaggggagagggagattttagcactgtatatcccaaatgttccctcttcgggaactatgtgcctccctgacattgtgtgcctctttcccagccatggaccctctccctgtgattactgggatgcagtattgattgtttctaattcccacttgtctgcattcttgcttcccctgtgtccacctgcctgggacatgtctttcagtactgaggacatggatcctcctggccccttccctctcttttgtcacaaatacacttttccaatcctgtgaaaaaggcctcggagtcctacatctctcctgtgccgccttgctggggcgccactgatttacacgcatgtttacgtgtttacagttcatgggagggagggagggaaggaataaaaggcaccaactgccaagccactgggtttatgacaccagttgtcagccaagcatagaagtcctatttactcacctttaggtaatcggcttatctaatgctgagagttttctccatttaaaggagagaaaagcccaagtgctttcttttgcctaaatttagagaagcaaataaataaataaagaggaatctgaaaaatgtgaaaccttgggagccaaattccctgtccctgtttgctatgtaaagtatgactcgccgctttgatctcgagtaataataattctgaggagttacactgttttcatatgcttcaaagctgtgtcaaagttttgctgcttaagggtacttctttattctgttggctcttgggtaccaagatgacaggtctcctgtaagaggtggaggctttttaaagttgtagccttcagcaaaacatcaaattaccaaatccagggtaacatacttctacacaaatgccttttctgtagatatattataccatatatattaaatactttagtgttacgtgctacattttatgtgcaatagaaagtgatggttggaggtagccttggggggacttttttccataagcagagaaagctagtgtataccgtatcaagtatggtttttacaggactttctgcctgaaggcctttgtaaataagtaatgatcaacagattggctgtgggtttttgaaaagcatgcccatgtcagtttgcatgatgggggagaattttcaaagtggatcttgctttcattgcctgcctgagagggactgagggagacagtcatcccaggccagagctgtctgcttcatagtacatcagaatagctaaatgggggtcaggtggtgagccaaaacttgccaagctacagaactcaggcttctcctgttggtgcctatgggctgctgatcctactaaagttaccatcatctgatgtgctatctcacctatctacaatgctctccatcatggctgagctagggaacaccatccacacaagtggatgatactcctctttgaccttgaatcctccccccccccctcaggtggttagcagtctttatctaatgtcagagacacaggggcagggtctatgttgagtcttctctattttccttcatttccagcctagcaatggaggacccaaccaaaggaccttctggttgaccttggaatgtatagcactgttaatgagacttccaaatccttttctttcagatctcttttgctgatttatacccaaaccttctttcctatttcctcctacctcttcaaatgccccttttctactcttcaggagatgggactccaaggtcttattccttataacagcccctccctgtccccagatccataaagaagctaatgacttgtttgaagtgggctttccagcatggtgccatgcctcacttttgagcagaatcaatcattccgagtgtgggcaggttttagtggcctatgggtggtgatatggacagcttgagagagactcagagcccagaatggcctgagatggtctataatttaccaccttggcttctacaaataaaacagcctccagagtgaggcctttctccaaatcatttgctggcaggaaatgtggggatcctccactaatgatcctgtctccttgtttgttctggtgtcaggctcaccctggtgttttagtggcacttcattccctgtatgatcactacataaatacccgtgtgtgtgtgtgtgtgtgtgtgtgtgtgtgtgtgtgtgtgtgtgtgtgtgtgactgggtatagaagtagtagagatttttttggcactgtacccactgagaagtgagccacagtggtccctgagtcccttgctctctctgactgtcatcccttctttgctggtttcttaactgagagttacagaaagaacttctagtttttacccagatcaccaaacctgttgtcttgttcttcctccctgacggattgctgatttgtaaatccctggagggcaagaatgttgtctctaatagctcagtcaaaggtttttaatttgaagcctcacagacccaatttcatgaacgctatctagaaagttagggaggcaagccaacctgcnnnnnnnnnnnnnnnnnnnnaggcaagccaacctgccctgtgatgaacagttaaaacagaacaatgtgaagctgaacctacccctcctgcccacaagacacacacacacacacacacacacacacacacacacacacagggactctatagttgaatccccttcagttttttcatagccatatatagtgaattgtgttctttggctcatctctagatggtgattatctgtacctgggctctcacatgtgttcataagtggaactccagaaaggctgtgtgcctcaggtgactgttcatctcccagattaattctcatcccgcaaatattcaatgaggcctactgtgtttaaagcattgtgggaagtctttgagcttggtggggtagaagggagtctagtctttaaaatgagacaggcaagcccatgccacacaatcaagtgagaagggtttatagtgtctgggaacatagaagtactgatgtccctcagtatggccaaggttgatttgtgaaagatgaaggcggtctagtttgccatcacttacaggagatcctcaactgatgttactatctccttctggttctcctgggcataaatttcagagtattatgcatgtaaactcattgatgatcatagctctgtgagcaagtatagctctctcatatggcagatgaagaagctgggacatagagaggtgaagtctatcacatctggggaagtctcatgtcatcagaaagatggaggaaaaggtgatgcttctcagaccactatatatggcttagtatggctacagtgaagggtccatggagtaataggacaggagctgaaaacgtgtgtatggtctggtctcccagttatggacgatcttgcctgttgtaggcatcaggaaactcttgcaggtttttgagggactggttccctaagttaggtgtgggaagtaattttataagggtcaccttggagtcctccctcagggcctttctgtgaccataaatatagagttgtgtaagaaggatcccacccaaaccctaccctctattagagttttctgggtatcaagggactcagagtttgccgttgaaatgtatatcaggcccaaattagacatcgttcctaagaaggtcacatggcattgctaatatcagtcctgagatctgcagagaagcacagacatgaggatttatgtgtggtatatgtcaggtagacaacttatacgaagaaatagctctcacccaggctagcacagaaaatgaatgatgcccaaaacagaggcactggacactttgaggagcgcttcatgccatgagactcaggaatcttaagacctcagtttcctaagagggaagggactatgatgtgaaggaacacattatccctcttgggcactgactgatcattaggtgaaatgaactcatctactcgttaaatcatatctcttctcttttgactcatacctttcatggggaccttttgttatattttctcacatcagaccctgccactgtgacagattctaataataggaaatggtagaatggcctagagcccactcagggttggggacagaatgccaccctcctaatttttccactgggcagaaaaagaaggaaggcagcgacaggttagctaaataaattcttgccctaatgcacaaactaacagcatgtgacagtcccccatgggaccagagaaaaataaatcatgggtgtcatgagtccaaggtttggatgaacttgacacaggaatcagaacaagttagtgcttagcagaaggtcattattctgttctgtcacttaaggggttatagagccaaggaccatgtacattctcctgagccatttcctcagggtaaaggtggtaacttccatttttctctgaagatgatgtgtagcaagtgatgctgtattagatagaaatgggaaacgccaatgcaattagaaccagaggacctgagagggtcccatgttgccccagagtgactagagcctggtatgaacgttttctatagatggctctgtgattgtcaatctggcagaagacagtggctgggtcctagaaaagccacatcccagagacaatgatggcggttaaagagttagatgcagagttgacagattctgtcagatgccagactacacaaagcaggatccgcacaacagaactgaaaatgttaatttcagagagctaaaaggcactcaggaatggtggctagaaccttcctactagaaccagaaccatgagagaaacttgaagtgatatgctctatctttcagaagtattcatattttatactggagttctaagtttcttccttaataacatctgtctggaccactaagaacattatacctaattcctcactgctacgtagttagggcagctagctccaggcaaactccaggcagccttgattgcttaaagacatactttatagtctcttcccaccatgatgtctttcttaatggcatatactctgtgttaactcaaatacactgtctctgtgtataaatgattagaagagcccagaccaagttatcataagataacaaaagaagcaggctcttgctaagcatagatactggaagcatgctgggtgctgggtgtagtgatgctcagagggcagaacactttgaatggttcttgtaaatttgattgcttattgtgtcctctgctggttgctgaaaatgcattgggctaggggtaggggtgcaagatcctggtcctgtaaaagtttagcatctaatgaggcagtcacaaagcccttttctctgaatgaacaactcacacctctgtagggagagactcacacaactcactgaagctgaggaagaacatttgaaccagaagatgaagtctaggaaacaccctgtagttccacaatcataccacaaatgcatctgccatttagatggaaaggttgtgggggcactgtgttcacattttaccctgatgcccatttctcggagctcactgcaggatgggttggcctctatctgggagggatgcttgtggtgatggaaaaggcctaaccatgtgatgaagccttaggtcctaaaaggtgaagcagggagaagggtaaaattctgaaactatgtagtaacaacttccttctttcaggaatttcttgggttccacgtgttttaatgtgagcttctgaagtccagtgttgaactcaaagccatacagtaaactgggttttgctgcctttggctgtaagcggaactctcctctttaaaatataattcgacttcctcacagcaggtttgcctagcaaagggatttgcggtttagctttaggctcttgtcttcaaggcaaagctttctgtgtttctgctgtggcagggcatttagttcacttcctgagattaattgatggcaagtggccttccttgctctgcacaccctcaaaacaaagatcttttattctcctcttgaagtcaggcatgcttaatttctagctgtggacattggaggaggtaggaattgagaggtgaggagcaaagagggggggagatgcctaactcactgggactgctgtgttagaagtagtgggcattcctaaaccagccttcagatctttggcacatgacaaagtctcacacaagccttaattgatttttgagccactcctaagcacattgtcttgacaaggggctcgccgggataattttctactgagcattcatgcaagctgtgcacttcatacatacccttgatgctgtttgccctctctttacagcttagggcattgtgacttgggctgcaggggagagggaacaagacacagctgcctcctgctggagaggggggacttaggggaagggggggacttaggggagaggggacgaacagtaccggcttctggtcagtcagtctttcaaaggataatcccgctgcaccactggagctattctaccaccccctcttctcacaagcacacactgtttcccatccacacacatgggctattaataaccaaaaatgcctatgagtattagtatgatggtcaaatgacaaacagtggggggggggaggcattttaacatggtaacatttataagatttcaacttatgggaactctttgtcatggcagtaggagagccgacagagtgtcctgtgtctttctggctggccttctccactttgccttcttcctttgaccataatccgagccaccaaagcaggactggattctaagccagccataaagaacagtagggaagggagcagtaaacacttggtgaagacaggtctgccgagctccgggctgtatgcatgatgcgcctttccttgtatactccctaaattgattctatttgataatgattgtactttacatttccattttacagattgagaagctgaggcagggtacagcttgccaagtatgaggcaaactaagatttgaagacagatttgcctctggggctagagtccccaacccaccatgtgaattgctttggaggaaataggggtagtttcttgccttaaatagtattgggaaaacaatactctcagttgataagactgactggctggtgactagtttcatctttcctctgggttaggctgtcaactgtattcagtgcaggttaaagttcagtaaacataccactcaagagagccctgtaatcgacagtaggaaattcctttccctaagttctggaggctaaaagttcaaggtggagacttcagcaggactggttatttctaagggggaagaactgttttagcatctctttccaacctgcagatctttttttcctcccatgatgttactgtgaatcttgttctatcaacttcagagtccagatttccatcctgtatatggaaagtcaaaacgggacccacctcagggatcttagttttataaatagcacagctcaaaatatgattatgttctggggtaggcagggggaagatctcagcatgcagattgcacagctgggcccccaacagtgaagcaacagctatagctgtcgcccagcacatatgctttctgtccctttaaaacacaacaagaaccctggcaagtcataagtggcacgtgggcattgaatttcatagggaacatcttaggagagttatggaatgacatgtgagtagaagaaatagccagtcactacatgaaagggactagtatttagtgatgctcagcagctccactaggtcttaaagagctcactggaggcctttgcaagctggagatatcggaatgccctgcacagagacttcccatgatcctcccctcatgcatagcaacctgcctgcttcctcctgattcccttggaccacactagtgttgagcgttatgctccatgacaaacacatggagctttttctagaaggacaacttggaaaattcttgatttaagaggtggaaatccctggagacacccactccttctcttcccacccgtgccaggggtctcatggcaggcatacaccagtgaaagacactcgaaattgctacaggaactgacatggtgaagaaatccatcatggctggcccaaagtaatcacgtagtctgatgtcgctgggaaaagtcacactctgagcaccaccagcccctcacagcagaatctagtgagcatgacctttaatggacctgtaagtctgttagtcttcaatgctcttcaccctaccccaccctccaacaactgttccttacctagccactaccttctagcctttcacagcctggcactgagccaatcctttccagatccttctagctacttctcttcccaaggaggacccactgcttcaaacctgaaggtcctctaggcccaccagcatttgtagttaaattaccactaatagtgctatctcttgtaccttactcaaaaaaaataataattaaaaaaaaacaaaacacccaaacctcattttctatcttatatgacatttttcatttcgggaagcatggtgtcgaatctacctgctgtcatgcattcgttagtctgttgttcgtatgagtcagtgggctcatcctctattgactgccagtacatatctacgaagctctcatacaactgcactgaggtttctgtgccttaggtcaagcaacaggacactggacatttccagtcatctctgttgggaaccattttgtggctacttaaacctcacttcttgagtggattctaacagctgttggtagaacaacacagaaatgcttatctttctcagcctaccagttattcccatggtcctcctctcaataggccaactgttgctggctttcccatcaacccttcccagacgccacgccagccaatggggaataagcatgttctttctggaagccttcacattgtcctgcatatgataggtatctgttagagcatgcacatgctagtgtgccgtgacctttgagctatattttcttttttctgctacatgtgaatctctatttgacatcactacaccttcctttcctggctaagaacagagtttattgataactcatgttgattgattactgattaaagaaaccaaagttggagattcgggtgccacatctggtctgtaaagtaaatatctgcgttcagggaaattttctgtgtttctcaggtcagacccttctggggaaatcctagatgatgtatatttaaatcatctaggcctgactcagtgacccatgtggagggcagaatatctgtggaactcctctgagattggctgcatgacttgacatgttagagcacaaaccatgtctccagtccctagagttatatatagctgctctccctgaactccagtcttagttagtttataattaacactcactgccactttttcccttcataataatggaaaagatagatgggaccatctatctttcttttaggccactcttactacatctttctgaccaaagaacaagggcaagagaatttaaacttgactctgtcttcagggcaggtctaagattctcttgtatcccaaaacatgttcttcaaggtttgaaagagactctccagctccttctctagagtagctttgtccacctacctaagacagatgttgaatagagaaccgtcaaagatttctcaaagttgaataagaaaagctctcatttactaaagtgtgtgtgtgtgtgtgtgtgtgaaggcaaccacagagggtcagttctctttatacaccttacttggcttctagggatcacactcaaatgtcaaatgcttgcacaggaagcacctttgcccacggatccatctcagtgaccctgattttggcacatttggcctcggctttatatgtgagaggtgtcctggtagcttacagcaccttaagacctgtcaacagccgggctactgagatgctactctgaattgggttgtcctgactctttaaagatcagctgtgacagttgctgcagtaatctagcatgctccttgaagatgacaccacaggatcacatcacaaggtattcatcatttgctgtggcctcaaagcaaattgccgagaataaaaacactcagtgagtttgctgtcttctccatgtgtggaaggcataatagacaggtcatgctagatgtccaaaagcttagtactttaaaaaaattgctgccttagtctctatagtcagaacaaaaaaaatgagaaatattaggtatttctcagggaaaaacattagtacataaataaagattatcctttaaatatctggaatagatcattttaaaggtaacatcacttcactatacaatattgaaatttaaatctatttctatttttggtctgtcttggtcgacagtttgcttaaggaaattaattttgctgcaagataggtctgcctgggatatcttaattgtacatggtccttgttgtagaagccaatgagggcttccaacatactcacatgctgacaatatcagatatagagtctcagacaatgagtataagttggtctgtaaggcttgtttcttataccatgggcatcgtagagttgcctgattttattataattccttgggttgtcagttagaccctgacatcccactgaagggaagacttctatgcagccatacttccagtgggtgtagccttgagaatttcaaacaagtttattaagatgcatatgagctggaggctctcatccagagaataccatgttgggaaatgaaggtggagatgaggggcctgtcactggactgttaagcacaaatacagttgtcaaggcgaggagagagggtgttgtttagtattgaaatcatgtattccagatgtggacatttggtagtcaatctgctctgaagtgacacgctgctgaatctttaaagggcttcatccagggagagcaaaatctgattgggcaaattgctaaaatatttaaagtgcagcctgttaaagcttttactgcgaagagcatcgcgtcagaagttgtagtcagaaagagcaagtaattggctttccatcctgatgccagtcagccagcatgaggctctattcctattcctccctcttcattgccaatgctaatagcaatcctttggtgtgtgtgtgtgtgtgtgtgtgtgtgtgtgtgtgtgtgtttgtgtgtgtgtgtgtgtgtatgctggggaaactggatagttggtaaaatgagacaacaatgaatgagatagtcataaaaaaggaagctgaaatgtatttatgtatacaaaatagcatgaagcccatttgcaaaatgggcagggaaaaaagcagaattactacctgacaaagtcaagtgcccttccagaggggtccatggacagctgcctttcaagggatattctctgcaggagaggagatggccattggtgacatccactttctcagcgtctgtcatctcctctgagatgtgactctgggggaccctttgcatttataatttatcacattttccacttaggttttcctgccttttctccccaggcatgaccccttgttaattcctggcaatgatcagattgacaacatggactccaatgtgaaaaagtacgactccactggaatgtttcactggtgtgcacccaaggagattgagaaagtcatcttggtgagtgaggaaccatgatgtcgacgtctgtctcctctgcctggcatgaggagtttgctcagagtgcagatttccttaactgaatagtagaggacactgtcacttgcaccagaggctgaagcggagagatctctgatcagaacatgaatttagggcagagttgttttctttttcctcccaagagcagaacttccaatctctgcatttttatcagaacaatagtggtgattatgtgtatgacaagttatcatgggagatagaatacacatcttcctgatcctcatatggctctgggagcagagcctggtcctgtcatctgatagttgcatggccttaggccagttcttgaactctgcattttaattatctcatctgtaagaagataggatgagaatgaccccagcttatgtaagattgtggtgcaaatctaatctctctgtcctcagaggcacctttcttttacctgctgttattatcatgattatttgtaaataccatgaagaaataggagttattgctgggattgttatcttttgtaattttgtttcattttgttttgtaacatgtttgtattcatgggcttgtagtaccgcatccagccttttctttttaccgggggtaacaggaatcaaactcaggccttcatgcttatatggcaagcactttatcaactaaaccatctctccagacctccagtagtgtttcctcccctaactaacttgttttcggtccttcttaacacatgatgcagacaggcaagtgcatttgctgagcgtgacattgcaagactgtggtccgttgtcatggtgcagctcagatggttgcttcaagggaaggctttagggatacctttagaaatagcaggtttctctgctctggcacaggaaagctagcccagacaacaatccattccactgtctgcctttgtcctgttaacagctttagggtttatgcctacactggcatccctagaatttattgtcttgctaatccctgaaatgtgggttaatagtcaggaaggctggccagactggattcttctcccttgtgcctctaatccccagatggctgtgggccttctccattttcaggtagggaaattctatcattttctatttcagggccacctttcctttaacaaggacttttccagatcctcagagtggttctatatgttaagccactagatttctccactccactatgctttaaatagtgtgtgtgtgtgatttcaaattaattataaattagcattatgagccaatagaggattgtgctggaagctatctcagtttgcaaaaactgcagacacaaagttaaaatgctcagccaacagtctttatgtgatttgccaggaggtgagatggttctaaccgcttatacactctgtgattggttaccagtggcttgctcacatctgaataatctacatagagtgtagtgtgatatgtgatcattatccctttttagaagaaaggaatttaggaatatgagttcatctgttcaaacagcatcagttaaggaaacatttatagtaaacacactatgggttaggtactgttcttgttctgagacatgacgcacagggctggattctagtaggccaaagggaaggccagtggggtggtgaatgagtctgtgagaacaatttagatatgaatgaagggcatgatcctgggaaggacagagtctagaggtactactgaggcaacaggatcgcaggagacctctctgcagtaatgaatagatggaatttttattcagtgcatagaggagaaaaatggagggctggagggcagagatgtggaagcacctgtgaaagatgcttatggaatcgatctattcactgagggctttggatgatttggaaatggaagagacagtgctctaattgaaaaggagataaaaaaattgaaccctgaaataatctttttgatgctaagtggtgtgagatacaaagtccgcttcagatccatggaataagcaccagtctggctttaagatagccagcgagtcccatcaagtccagataggttctgattaggagggcctcaagggtgtatggggaaactcttgaagggattttctcttgggtcttaatcataggcaagtcaggctctccaagtttgaggtacaggactggaactttacacacttctctaggggatgtacctgtggcatcattgagaactggtatttgccccagatctaagctcccgaggttagcttctgtgcctgaaccattctgccaactagtatctagctaatttttggatcctttgatttcaagtttccatcctccaccccttttgtacttctctgctgaggggaaccagattcttaggtgaccaggccaattgaaaatattaaggagccccactcataacacctctctgcttctggctccagccactagtacttctgtgaggccaaagaactaacttcaggtcttccccacaaagtggcaagaagtgatgggagctcttggggagcctcttgggtcaccttttgtgacacgtttcttccagcgcgtgtctcaagcttccttagactctgggaaatcagcaatgatgataggttcttctttattcgagaaatgaaagctagcttcctcctctcctggttttttcttttttttttttttaaataaccctgacaatattgtgaatattggcgtttaagcaatcaatacactggtcagtgctaaggattaactcaagcagaagctggtatgtccagtggccattaatatgcctctgccaaagcattgtaacccactcgggaccttatgagcatgtgctaaggaacgggaaagatggcaggcagggtgaaggtgttgacagaggagaaacaaagaacgagcccaaccctgacctcaccctgttgtccttttcacttgtataatgagcaaacggccagtgatgggcagatagccatttgcattctgggtaactggggtcttcccctacataggagtattccttcctttgtcatcttcatggatacaggtctggggctgggaaaagacattagtctgtgtctttattgattggctgctagacccttatcatgactatttgtgggtttttatatgaggcgagcccttccaaaaataatccaggaaaccctaaagtctgaacacagggtcaacatgctttttctgtagaaggaaatattgagtgatttaagtctcagaagccatatgatctctgtctcaactgacaactcttgttttccattaaagcaaccatggaaaatacctaaatattatgaattggctgtgtctcaataaaactttattggaatgtgaattttatatgatcatcattcatagtgacatttctaatgttgatttactttttagccattgtaaattttaagaaccagttttaactcagtggacatatagaagcttgtaggtttgtatcatcagattgaggctacagaccacagcagccagcctatggtttcagatatcacattcgatctactgagacagtgaggggtatgccaccttactgaaatatctaaaaagagcacctcaaatttcacctgagaccaactaataatcatcttagcaaaagggcctaaagggatctcattttatcatccatttttctctttctctctcccttccttccttccttccttccttccttccttccttccttccttccttccttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttctgcctccaagtgctgagattaaatgatttatcacccatatttatttatttatttatttatttatttatttatttatttatttatttatttaggtttttcaatacagggtttttctgtacagccctggctgtcctggaactcactttgtagaccaggctggtctcgaactcagaacctctgcctctgcctctgcctctgcctctgcctctgcctctgcctctgcctctgcctctgcctctgcctctgcctctgcctctgcctctgcctctgcctctgcctctgcctctgcctctgcctctgcctctgcctctgcctctgcctctgcctctgcctctgcctctgcctctgcctccggagtgctgggattaaaggagtgtgcacgccaccacgcccagccttatcacccatttttatggccactaagacttcctttttttccacatacctaaacatcccccttttttgtctttgttctcctaaagattcctacctcctgtctcctgttcacaggtctacatggtatatccttcttaaacctattgttctagaaggtagtactgtgtgaatatatgcttacaggaatttatgatataaatagaatatatgcccctgtatatattacaggcattagagagtatataacatgtatataatggcatagtaaaaccaatagctgtcctgtaaaccttactggtattttactttgatggttaatagaatcaagaaagaaaaaaaacatagtgccttctctacatgtatgcttgctgtatgtactaaatttattagaaagatttatttgttctctaacatgctggacatggagttttcaaccagctttcaacttccaaaaaaaaaaaaaaaaaaaaaaaaaacctggtgtttatagcagcccacatggtgacctgagttttaccttttttttccagctccccactttcctgagtagactttatccattagaataggtgccttgtgcaattttatacatgacgttgaagaatcacttcttttctattattctgaactaaattaaaccttttgttttactacagtacaaataatagctgtattgggtacctttgtggtattataataaaaatgtctgacatagctaactcacaaagagaaaaggtagctcacagtttaagaagttcgaagtctaatgctgggctgccccaattgcctggtctctggtggggtggtggatgatcatagagtgtagaagcaaacatgagcagagagaaaggaggtgtgtccatgtttgttcttctcatactgactgtctttggagaagacatggatcaaggagtcacatgaaaactcctaggcagttgtacataaactgctccacactttcaataatctaaggacctcaacaaggctttaactcaacaaagctccaccataaaataatgctattctaaagacaaagactttaaccacaaagggctcttgggggacactctttagacatcacctaaaccacagcagtggtccacagtaggtggtcaatgagtgttcgctttcttctctgcgtaagtgatgctttctccccttataccagtgttgtgagcacttctttctaaaactcttgcaaccctctctgtttcagactcgaagtgaagctgccatgactgtcctgagtggccatgtcgtagtctgcatctttggggatgtcagctcagccctgattggcctccggaacctggtgatgccacttcgtgctagcaactttcactatcatgagctcaaacacattgtgtttgtgggctccattgagtacctcaagagggagtgggaaacactgcacaacttcccgaaagtgtccatattgcctgtaagtcaagtcgcactatttaatgtccagttcttcatctttacattcaaaagaagaagtcccaggtggctgtaattgttgaggctttgatcgtgtctctgctcctttttgttgctacaggcctgaggacatagctgtccttcccctgtgctctgctaagaaagtaaaaccctgggaggccttattaaaagaatttgcagccaagtgcagcctcttgtcgggtgaagttgagctaccttcacacgcactagcttaccattgtctaaactctctttcctgggcaaaatttagaacgttgccctattttgatatatgcaccaagaattcactcataaaattattgttggcattttaatttgacatggttaatgcttagagaaacacagatctgtcccatctttcatctgatattggccaaataaataaagagcagatttatctctactgtatggaattccatacctctgctctgaccagcctctattcactctttgtctagaaacccagaattttttccatggctttctgtgtttgtatatacatgtaaaagcatgtatccataggtgcttattgattgcaaagatcacaggacaccaatctataaaagacaatttgggactccataatttagtgtgaaaataagggatgagtgatttaaaagtcaaatggatagtaactttctaattataatatattctccacaaaattttagacttaaagaatattaattcttttcaaagttttgtgtggttgcctatgtcagaaatccagaaaaacattacctatccttcaactatttttattatcaagtcatacctaaaatcaagagacatttagccccttagctgtcaagaagtttgttttctgcaactttttatcagcttgcagaacagcagaaatgcagccacaagagccaaggaatataatgtgttaaagggtatataaggggctatccacagtcaccacccttatgtgcaacatgtgtctcccatagtgcctcatctaacaagtctcttcatttccaaaaaatgttagacagaccaaaccctgactgctttaatgtatacctgtagttaaaggtggtcacctgttacaattcactcatcaaagaagcatatctgcatactgtgtaaccttcactaaattcagaaatatgaccaatcgatttgattatacctttctgtggttatcactatcttatgtgtcctattccacatgacccctttacctctgaaggtatctctgtaaaactaatttgctaggtgcacaggtacatatttatgtaggaagggcttgtgtgtatttgtggtatttgtgcgtgtacacacgcgtgtgtctctgtgtgtgcatgtgtgtgtgtgtgtgtgtttccttctgtatgaccctattcacatttcctcacctgcctctgcaagtcaggatgagtcttatatttgtagagcctttataaattcccccatatttagcatacttaagcacagtgggcttgtacattataagccctaacccctgtcttcattgtttaaactgtgtcattcctataagggtatccgagagaaacaaaagctttatatatatgactttggtattttttgtgccttgaaatcatatgcttacaactggacgtgagctccttcagatcacaattactgctgactttcctacaaggtgaaaattaaaagaacatggacatcgacagctgatgtttatacgctggcaatgtgatacaaagagttggtcacacttaattttgtaccaagctaacatagaagacagtgtttttttgttttttgtttttttttccttctccagggtaccactccagtgcctggatcagtttatggccccaaatgccctttctctatggctcaactttacagcaatatttaggagcactagaatagaatcatgacttctactgcattataaagaggagctaaagggctccatagttatccagatcctaatttcccaaaccccatttagtgatggggacaaggggagatgtatacagcagctggcaaacacttagccactagaggctgaggctgaaggtaacttgtgtatccatatacacaagggaaaacttaaatccatctagaggatctgggatgcttttggctgcatgagacccccaaaatagtgccgtgcagctgctggggggctctgacatggcatggccctgtgtgcaagagtattcatccagtctatcaaatctaccttacaccccattattaaccttgcatctacagaggtttttctactgtctcacattgttataggatttttaaaaactctgtttactggcttatttatttttaattgcaccggtaatatacaaatctgttcttgttataaaatattcaaacaatatcagagtatgtaaagtcaaaagcaaactttccactccattctttcctctcccagaggtaattactgttattagtttagtgtatagtttttcccgagttttctttttgaatttacatatatttataaatatataatttttacttcaagtagcttcatttattccaaataaatggagttatactttttaaatggttcaagatactcacattcccaccacttactaatccctttatcttggagtttattccaactcagtgagtttatggaagactcggatgtgcctatagtatacgtcctctattgtatatgtgtcccaaaataaatttaactactctcatgttgttagagcattgtgtcctttccttggcatttttttcttactaaacattatgcaataaaattttatggcccgaagcttgcccctttgcctcgcccttgtacaaaatgcacactaactccactggctccctcagcctcctgattgagcagagccatgagctcccacctcctcacaccctgctttgtggatttccccatggctgctttggaaattctagttggatacgctgtctgttgccagagacagaaatgacctgctattaaataaacaggcatttgaaacccacctcctcgttatgttctgaaaggcagaggttgccacaggacagttacttaaatcaagacaatttccaggcaggaggaagacgtagaccctggcattattcgtctcgggtttgttagtaatagcttgattgagtattgagaactggcctgaaatgctgccatcagcaccaactaccctttagattagcgtgcagcccttattccctgaaatgtagttagggcagcttaatgtcaagacataaaaaagatacttgttaaataatgtcccaaagctcctgcccaatctttaatttgtttttattttttctctttccctcttctctctctctctctctctctctctctctctctctctctttctctctctgtattttcatattctttctctctctccctctccctccctctctctctctctctctctccccctaccacccccatgccaaagggtacaccattaagtcgggctgatttaagggctgtcaacatcaacctctgtgacatgtgcgttatcctgtcagccaatcagaataatattgatgatacttcgcttcaggacaaggaatgcatcttggcgtcactcaacatcaaatctatgcagtttgatgacagcatcggggtcttgcaggctaattcccaaggtaaggacagcctataatacttctctgctgtgcctatgggggacaggggctggcaagagggatatccttcactcagtaattcaaagaggctcacatcagcctgtctggcaatgaaacctgtggtcgccacgatggcttacagaggagcatctgttcttcctgccatctaaagatacagacctgaaacctgatgtatgtctccctcccccagtttgttgccttttgaggcaatagaagcatctttaaatgcctactctctctgccttttcaaacaatgggctttatgaccagggtcactgtctaagagccagagtaatgtataaatgccagctgtacaatttccttctctttcactatgagtacttttctatggagctaaaaagggaatgttaagctttgctatggctagtgtcacatgcaagactctactcgcctaaggatggagatctctaatgatacagacacttgaagctgtatagcaaggagtgatgcttgctggactgtacattttcctatagaaggcacgggggcctgaaatggcacatagctgtcttctctcttggcctcaatcttccctgtcatttgttcggagatcctggacaggtggttataagtgacgatgtcatcctgtagtctcagggaagcggcacagcaagtaaccccataatgaatgaccttggaaatcaggagagagaaggataggagaagaaatattttcttctgagtgacagctctatatgggtcatgcaaggcttactgaatgggagtgattgactactgaattgggggcctcactcccattattccaaggagcaaaggccacgagagttgtaggaggcaggaagctcctcactggtagctcggcatcaggagcttctgggagcttgactagatcttggggctaagaccttgatgctctgctgtctctgaacaacctagcattaccacccatgcctcaactccgctccgcattgccagaaaaccaaagaccctagtacctgaaaacccctccattgcaggttctcttccttgcactggccttggtggagagctagcagggagtggggggtgtgggactgggtgggggaggggacaggcaccctgtggtaggattggggtaggtagtgaaagaaaaggagaggcctaaatgcttcccagtagatccaggagccactgtgcagttcaaagccactctcaggggagtgtcagccttgctgctgtggaccagaagaagaggcagagccattcttggggtccctagcagctttaggcttttgctgacttgtgcttctccaacctttctgagagttgcatcagtctgtaatacttaccgagtcatgcccagcttccacttttctgacataaccctgcctcaggcctaactttggcctctccatcccatcatcttgcctgatggtcgaaaatataaagattggtgcagccacagaagaaaagaacaatgtgccaaaacccaaagagacaccctgagttctgccaggctgtatgcataggaaacagaacttgcctcctgcccagcttgcccagagagcacgggagaaggaatgtggaaagacagtgagctgaccttccaggggttggatgcagctagctggtatgtgttatcttcctctaagtccctgctctttaatttgtcttccccattctcaccctgatgtgagcatcacctggggcagcttgttggaaatacatcttgccagggcctaccttatactacctgtcagatgtgcattctaatgagatccctgggtgactggtacaggctgttctaaagcagagcatcgaacatgctgatcaactctttcagacatgcctcctgtcctggagagggaagagcaaagggatgggaaagatttgtgaggagcacttctcccctgggttagagacacagagaacaggagagggcagggagtgctccctttctctggccgacctgtgtcctcccaatatagtcaggacttcatggtctgcagacatgtaataatacaccaccacgtacacatgtatacttgaaatggcatgtgtcattttctttctcaccctatcttctcctatcctgtcattggcctgcatatcatcctctggtcccactctggtattccaatgacaatggtccagtggtagttcacagcaccaagaactggctcttctccaccactcacctctagagcccatgcagtgtgcacttctttgagttctagccaccggatagagaggggagctgaaggtctctgctgttccccacctctaagatctctttgactagctggtatccccagtggcctcagatccttgcttctccatacaggtatttggaaggtccatactccaagggagcggttggagtcacaggcaatagaggcaccgcattgttctttgcattttggacaacgtatcatatgtgtccttaatgtaaactgtagagtttcctcacacctccccaccagtttcatcttgatgaaccacatggtccttgacaaaagcctcacaaactcctttacctatgcacaagccacgttttgattcttccagaacccagctggctccagaaatgtggactgaggacagctggtctgctctattgtggagtgctcatgtgaccatgtggaagctgttttaacatgctacagttgaccaggataagggcccgttagaacagcactgagaagtccagccaccatgggaaggatttgcgtctgtgtctatgcccttgccagggcatgttactgggactcctctcttttcccctttgcttctcttctttagtgtcacttttctagcccacacggtgtcaggactgacccagcctagcgattctggaccagagactttctgaaaggaaaggagatgtcatggctgcttgtcaaaaacaattacagcagaaggcggcatgttccatgtgggccggtatatccgatgtgacatttgggtctatgagatgcagttttaatatacagcaggcaaaaccgcactgacagtcacataaagcaggtgaagctgcctcttgctggtcagcaaacatcagcgccgagccactttacagctctttaccagcgactaagtgcctttatttgcagagtgcctgtcatttccctttggctggagagctggtgtattatttagcacgcatttatctagggaaaacacttccatttaaatcagctggtacaatagtgcctcgttgccagcccatttccctgtggtgctaaaagatgagaaggaagtccgatcttgggaagagtcagggttcattcccagagagcctctgggatcagcacctaaaatgagagatgtggtgcagtcgctctctttttgttgttttgttattttaaatataaaaaaatgtgaaatgagcatcttgcaccttattttctcttccagtcaaggcttctcttagggaagagaaaggaaggcaggcgagtcccccatgctccagccactctaaaggacagcagtgacttggattcagccgctccctagcagcaaggaactcagggagtggaggacaatgacaatacagagaaaagagggctgggttagcagaagagggacccagagaggggccttatttcatctattcacacatctttgtaagtcctcctaatagaggcgacagctgggcatgcattgaatgcaagtggctattgagcccttgagataggcctggtgtcaatgcaatggaggaactgaattttcccctttcttaacttttaataaagttacacttcagtagcatcaactgctctttcattgctaggacaaggtatctgacaggaagcaagtgaaagaaaaaagaacggattgttccggctcatagttcacagggagatatactattgtggtccggaaggcatggcggcaggaataggagaccagttggtcacatagcacctgtagttcagatgcagagtgagcaggaagtgggatcaaggggatccagctataaaacgtcaaggtctgcccccagcgatctctccccagcaaggctaatggttccacagccttctcaagaagttacaatcagggacaagctagtatacatgtgagcctgagaggggtagggcatttctctcccaagttatgagaaacagttttccacagctagcggctgtataactagacatcttactgtggggagataacttttttgacttgctaagagttttgatttggggatatcatccaagatttgtcagaccagggcaagtatacatctgtctttgaaaaatacagcttgaccctagctaaaggtgagtggtgggaaaatgttccagggaaatgggttgctgctccctgcacagctttgtagtgtcagaatgaagcaaggcagacatggaggtgaatttgaagtataggagagatggttgctgaagacagtggataaaaacaaagaatgggtcaggagctgggttttgagattggcgactagacgatgaccttacaactaaggaagaagacaggaccaaggaggagatgtgaattggggacgaaggcaaagaatttagtcctgatcactttgcacccgtgaggaccacaaggaaccatgaagatggcctgcacagcctgcaggttaattcattagtgccgctgtgaggagcagtaggtgcttcggctttagatggaggctgatatgaagcgaaggactccattctctgaaaggatgcagatgctcttccacttgtcctggggtcatatcccagtcgactgatgagagttgaaatagcatgccacaggccgtggagattgctccactggtactagaaacagtcgcagcagaaacctgatgacctgagtttgatccaggacctacttaaaaagctggatgcagtggtgcatgtccatgatcccaacactcctatggcaatgcaagaggcagagatgggagaagcagctagaagttcatgggccagccagcctgaactatactcctgccgttgattgatgatccctcttttctttgcatatttttggatcatactagctttctctggacttgaaaaaactcaagaggagtaaaaagtggcagggggtggtgtgggaatcttttgcccaaaggttccacttgccaacctggcttctgtcacgatctcaaagtaataagtacaggtgtcagctacccagcacatagctttggaggtaacccagctaagatccaacatttccttgatgtatgtcccaaagctagcaggatcttgtccttgaggcaagttgaagtgggggaaagggacaaacaatggaattgtgggaaaaggacagccagaatgaggaatgcctgaatgagccatttaccaatggttaagaccaggaccaacagttaataataaaaagactaggttttccctttaacataaggaagtcattcccaggaaacagatcaggctctgcagagattgggaacattctaccattgtgtactaaagggaagttactggccaccatgatctctgtgatgagaggcagattggatgggatgagcccagtggtccttttttaactgagcgtctctggaattttcttggtttttattatacagagttctgcattttataggttctgtagccttgctccagagggagagctgtggtgtttggcagaactggggtcacgggtctcttagtggaagtgttcacatccttcctgaacggtgatggcagtgtggccagtgccgggtgagcacctacacatctggtgtttccattagagtgacagaccaccccattcccaactcccatgtcactcttcaacatctgcccttcccactttgtgctctcctcctcctctgagcctggcttcttgtacatgcagactaccgacacacctatgcacgtttcttcccacccagcttcactccctgaaatcagagaagcagttttttagctgctcctgtatagcatttcattacctcaatattctctctcaattctaaaatggcagtgggggagcgccatttctctttatgcctactgaacgaagaaagctcagcactaaaatattttccttccgttgtagctgaaatggctgttggcttccatcccaaaaaccagaaagacaattctacttaactgtttagagatttatacataccacactggagtagcctctaggtagtaactttagatacccagcccaataattttcttttattggcttgtgatttagatcctatttggaatcctccataataagagtagtacatttcattaaaaaagcttactaaacaataaaagaaagtctggcttagggctctgagagggtctcaagtacagagtggggcctgcgctgttacatttcttctgcagacttcacaagatgaatctcagcccactagtgccgatgtgtttggtgaagcagcagttgcagttgcagctattctgtaaatgcctttgagtgaggagagcttttcctacatagcatattttgtcacatgaaagaacctcttaggaccaccatttgctgttctggtgacacattcctaattcgataaacaaggattgacaagagccattgcaacatgagattgaggaggtcatactactttctgacccatactgagtgccttccaaacagagagagagagagagagagagagagagagagagagagagagagagagatgcacatgcaggtatgcataggagcatgtgtgtggagatcagaggtggacatcaattatcttcctgaattgttcttcctctctgattttgaaccatggtctctcattgaacccacagttcactcctgggattgtttgtttgttttcctttgcttgtcagtttttaacgtgggtgccttgcatctgaattcggatcttcgtgcttgtgctttaagtatgtttccaatggaaccttctctcccactccaacatttttttctttgggaggtgaaaatggaaaatgaagtaaaaaaaaatacaggaagaatcatcctttccttccatctgtatacagagcagttgacatccccatgcagactctaaccagcctggggcaacacagagagagggaatcttagttttggaggcagaaagcagatatggcgtagtgtccggaatggactcaactcatcacataaacgtcagactgtcacctgttaggtgactcctccaagtgtatgtgcctcagtcatgtctcttttaaaaactgtaatgtctttctagcttacccaggtgagccatgacccctactttcacatacagtgttatataatctccctggaaacctgctgaggcagagattgcactcttcattttaaggaggagaaaatgaggctcagaaaattaagcatctattccaacatctgagttagtcaagaacacatggagctggtccccaggcagtctgattgtaaagaaggtatttttccaaccacaccaatctgctccaattaagacaaatgttaactgtgctctgatgagaaagtgccttgactctgtgtatctacttttaggggttatccttggataaacattccagggaagaaagtaccccaaaaagtctgccttgcccctaaattacctttgtgcccaaagggctgaagtttgtcttgaagtgtcttttgtctcaatgagtcttttgtggggtagggggtccctggctcttcctactgcaacaagaatcactgggaatccttaaggttgagtcttttgctccaaccaacaactatgcagagaatagagtgggaggaaatgtataacattatgctgagtttttcttcatgaacaatagattcgtctgagctgttttttccctatgaatatggatcggataagctgtgaagttgatttaatgaagtgattgccacttaaacatgaaggcctgagtctgatttttggcttatgtgaaatagatagatatggtggaatgcatctatacttcagtgctaggaggcagagaaaagtggatatctgaggttctttggcaggctagccaacccaccctagtccgtgagcctaaagtctactaatagaccctgctcaataaacaaggtagatggcacttaaagaaagacactaaaggttgatctctggcctccttatacatgcccatacacatctgcacacatccatgcccacttcaccaaccaccaacatatgcatgaatgcacatatacactcaatgtggattgactactgaaatgtcagaaaaagtgtggaacatttgaggcttgacttttgttttcttttgtagagaaatgtttaaaactatttctgtttcccagaagagaagaaggttcagtaggaagcatcaggttaaaatgaacacaagcttctactccccaaagcccccgtgaatggtccagataaatggtcagataaatggttgtatggaatccatgcaaaattatttagtcaaagaagacagtgaaagcctattatcctatagattctgtctctgttctgcccccttactttcttttatgtcccccatgtctttctctctctctcttcctcccttcttcctcttgccaatgcttcccctttctctccctccctctcttttccctgtcaatgaagttctgggtaagggaggactttggctcagccaacagttcctcttctgagcatcagtttcccttacatttgatgctttcccttacacttgagattaactgttcctgtcatcaggaatctaatgcgatctctacagacagaagtgacagagacgtgcacaataagctgtgtggcatcatgtggatgcacatagttaatgatatagggtttgggacattccagagcaccctgtaaagttcctaatgcgagccatttgtaacttcctgagacctgatttaatccacatgctgaaaataacatgtgtgcctcaagctagcaagaaagccttgccaaccatccaaagcatttttgcctctacctatcttttttttcagctgaaactcacgtgaagtctcaaaccatcatttcttctttcctatgtgaccctgcaaagaaggcatctaatttacaaatgacttaagtttggagatttttaaagctcttaaaggtatccgtgagcctaaatgcttcaatagtattttatggaatgttctagaggctccccctccatttgtagagcagtgtatttatccctggccatcttgttacaggtatcttgtcaagatgttctatgaggtattttaaggccatgcagatgtgtggtgatatgtcacgagattgctttgggttgcaatcagttttcaccatggcatgtattaactatttttggatgaattacttgggttcaaatctatctctgccactgatgaagcccagacagccacttcagtatctccgtgtctcatttttctcattctcgctgcctttggatcaagttgctctcagaatgcaacctttaagtaaatcagaaaaggctttctcttttgtccagctccctcatttctatctgttggattgactcaggtcaggttttcatttttgaattgtccttgcttcttatttatttgggctattgactgctggccagatatctggttattaagtcatttttctcacttcgtgcagcaccttttcctttgtttgatggtttcccttgctaaatggatactttttactttaaaaataattccacttacttattcttgcttttgttaccagggatttggtgttttatttaaaaccaacaaagtgctgaactctacctcgaagaggtgtctccctatcttttcttctaggagttcctgctagaggtcccatatccaagtctttaaacagctccaggtccatttttgtatgaagtatagggaaatggtccaatttcattcttcgacgacatttgggattcagttttcatcacgtgttttttgaagagactgtcttgttcccatgaggtgttcttggtgccttgtttatagattagtcaatcatgaatgggtagattttctgattgagctattggtattcaaccttagttgcacaatgcagtcacctcaaggatttgtaagaaatcttgagatgccccggctgcatcccaggacaagttagtcagtcatcagaagtgctatgcatcctacaatgaccccaacgcacagccagattgagaggcattagttcattcccttcccttcccttcccttcccttcccttcccttcccttcccttcccttcccttcccttcccttcccttcccttccctccccttcccacggtcactgttttcaaccctcctatcagaattgatgagccatggacgcttcctctcatagatctggcagccttgtgagtatgatggctgggaagtttggatggcatgtaacagaactcattaaaatgcaggtataatgagatctaaactttgatacacaaacttttgcatggttcccggtccaccctacacatcctgatcaaagagagcaaaagaaagcaaccaggggaattgccacttgggagacccacacagatgggcacgagcagttccttgcatacctgatgggcataggaatgggaagaattctaaaaattagtcagagtgcatgactgaaagcaagcaagaagggtaaatgatgagagcttcatggctgaggtctcacacttaaacctactttttaaataggtctctgggtggttctaaattcatggtgactttctttttattgtgattatgggagggctattctacactgcggaaggaagacattactatcaccagagtgtttctcatctatttatttgcatttaggatattgaggaattaaagggggaaaacaactctttgcaaggagcattaattatatgccatgcaaggaagcaattgtgtctatgttatgaaatattaaatcaaaatgcctcccattctcacatgtcccagagataaatacggcagtattttgaggcccctctcggagctgttttgcctgcaaatttattgttttgtctctattttcagaaagccctgttttctgtgaagtatagcactctaggtagtttttaaggcacaaactcctctagagtcgtacactggtaacaactcttatgtagatggtacacaagggatggggttgatcgtctcctttaagatgacaaatgggcagagggggttattgtctttgattgcaagccttacatcatctgtatgtaggaataagagggccatactttatctttagccattttataaatatttaagtctttatagttgccgaaagatattaaagcatattttacagtagtcggagtataaatattatatatagcacaagataccaaagtcgtttaatgaattcataattttcagttcacatttattggaatgtgttttatgttccaaaaaaaaaatcccatttaaaaaataaaatctcattctgctccctgacaacacacccagcattggccagcatttagggtggggcatcagccacaccatgcggaggtttccccttaggaagccagaaggcaggaaggcaggcccaaggaaatatttcctcaatcactaagcttaaaaaatattcatccaatattctttgagcaaacacctttggcttatatagcatctcagcaagcaaaaggaggaaaaatactttttaaaagaaagtattctgatgtagtccaggctgactttatcttgaacctcctgcctccactacctaagcactgagagttacagcatggactactatagttggctgaaagagaaaacgtttccataaacattctctggttttgatggattcctttggaagacctgaggagggaagagtgaagatgaagtctgaattatctatcctccccttccccaactctctttgtaaaccagaaggagagggcttcagggcacagtggtgactcagagtctagttttggacaatggcttcccaatgcattctgaataatcctctgtaatttagagagttcctggtgggttgtgtttcctttggtttgggggtttctgtttgtttgtgagttgtttgtcttctacccttttccttcgtgcaagggagtggcatacagtgtatgactacatctcttttcaattttccagcgaaatataaagacttttcctctttaatattttacaaagtttctccagctcccagcgggagtccatgctgggtaatgtttgctaattaccaacaacaaaactagacatacaaggctggtaaattacctgaccctttccattttaatgagacaacaaggatttcaccaagtgatgttgtttcgctggttaatggtgtcagcaatgttgtaattgtgggttgagacacattagctgaacagccacatgtagaaagggttttctctcaacaagccctttggagactaacgccatattatcattaagcctttgtcgtttgcatgctgctaatcacttactttattatccctcgtatccattgtctttctttaattgctctttaaattaaaattaaaaatagtttgaaagccctcaatggctagaatagcatcttgattatgaagataacttcaggaacttcaggggctggtgatgtataaccaggattaggagagtcctacagcctgcgtgctgccgtgcttgaaggcctcaggggcctgattgtggcagtttctctttctttagcctgtactgtttgtttaataaatggttatttatggcccttttggccattagagaaacttctaaaaagaagtacactcttttcataagtctgggcattgagcaaagggacaaaactgaatgggaaagaaaaggctgggcaggagagtttgagaaagcatcctaggagacccagttcccattctagtttagtctgtggacacatacttttgtcatttggggtcctgaaagggacttacacctcagagatgagaaggcctttggggtcattcccatagatgaaggcaccaaggccattacaattgtcacaactctaacctcatggcagcaaatgaagatgctttgttagtggaatgaattcaggactccttgagggagaggggaccatgcctgagggctacttctaagagataatatggttctgtgcctaggcctgtaatttgctagctgcttggttgacatggtacaatgtatgtcccttggatgtatgtgtcagcatgtttgttgatagactcctaaatactactttaaaacaaacaaacaaacaaacaaaccaactccagtgagatatcattgctgactattgagcgaccaaagcaagacttaaaaacttcccagtgttatgtctaacgtggcactcacactcgggagatttggagtattgcttttgcctctttttaaagatggggaaatcaagaataatctatgtgttgaatgcccatatgggctctttcagagttagaggttgaccttggactaaaatccatgcctttggttttctctgacagatcaatagccaattgttgatgaataataagtagttaagaataataagcagttaaaagaggcttgagaaatagcttgctcaataaagtactttcatgcaagcagaaggacctgagttcaatcccaagacccatgtaaggaagccagccatggcagttagtgtttgtaatgctcgaaatgcagaattagaaagagtgggtctctggggcttgctgcttggccagcctagcttacttaattagtgaattctaggtcagtgagagaccgtgcatcaaataaaacaaggtagatggcatctggaagaaagatacttggaacttatctgtagcctacatatatccatgcatgcttgcacatgtgcatgcacacacacacacacacacacacacacacacacacacacacacacacacaaagttagtatttagaagtacttgctatagtattgaaagttggcttatgggaccggagagatggctcagaggttaagagcactgactgctctttcagaggtcctggagttcaattcccagcaaccacatggtggctcacaaccatctgtaatgggatctagtgtactcatatatacataaaataaataattaaaaaataacccataccattaatatattatgatatatattaatatatcaccatatatatatgtatatataaaatatgtcaccaacccatttacagtcttcatagcatgttactatttcatttatagatgatgaaattgagacacaaaaattaaattgccctggaccccaaaactagaaactgaaagagacaaagctgaataatcagtctgtcctagctcatttctgactgtaggttgtagtcaaagaatctttagtgctcacaccttatgcgcatgggcaacgtcctggaatggactctcaggattaaactagcactattcatatcctcttgtgataattactatgtgcatgcaggcacacccttgttctttctagatccaaagtgttaactatacatttatccttcaataaaaccatatataccgaaggtctttcatcccttaaaagaaaaagaaaattaaatgctttcatttaaaggattgttaaaggcttggcaccttagtatctttcttggcctacacaccctttctctagggcagtagttctcaatcttcctaatgctatgaccctttaatatagttcctcctattctggtgaccaccccccccccaaccatataattatcatgttgctgtttcataactgtaattttgctactcttatgagctctaatgtaaatatctgacctgcaggatgaccttaggtgacacctgtgaaagggtcattcgaccctcaaagcaggtctcaacccaccggacccatcagggacacctggaagagggttgtcagtgataggattctgtttttctaagttgtgtggccaatccttctgtcacctggtaaactagtcctttacagctacttaactgtctttgaatttaagatacagttggttgtttgagttgccttgtgcagttttgcttggctattggttcatgctaaacaaaacaactgtggcccatttggcattaggtagttttaaatgcaaaaggacatttgaactgcaagacaaatgctgggaaacaaagccttcagccctgagaacgcaaggggactgtttataatgaaaaggtggttgcatttctagtcaatctatcactttaatgagctctttgtagttctttgattaatgttcacaaaacagggagaaaaaaattgatgtaatggaaacaaaatgctatataatcttggcagcaggcaggggcggatttctatgtgttttattagcacccacgtcacatcaccctcttgcaaatgtatatgtctgcatgttccctgacatagcaaccctccagtttactggaaatgcaatctgtcatgaaagatgagaccttatgttggtagccagacatcctttgtcccattatagtggcagtaggaggaagagctacccagagcaggaatggagaatcgctaataatggtgaaaagttgggtttggtctctgccatattgaaatgaggtgtctactaggtagatgacaatcaagaggagccagggcaagatgtttaaccttgtacaagcattagcatgtagcaagtactatataatagcaatccatgtactttaaataagtccaggaaagggcatgatagaattcagaagacagctatgtgaagcaactcagtgtgtgggcagaacacctctaaggctccccagaggaaaaggctgaaaagctgattggaaatggaagggaggagacaacaagtttgaagtgggtgggagtaggaccaagaatcaggacaggccacttatccctgggaaatagccttggcttgcccttactgcagtagtgtacatgaaatatggaggcttttcatggacttcttaaccaccaaagagcatcccatgtcagacctctgctctgacagtggctcctataaaatagtggggggttgaacagcagcggcctgggaacctggaacctggaacctcctcggctctcgtttcactccaagcctcctgactcttggagctgtggtctggccagtttcttctggaaacttcagcctctcagaatgaacttgtgaatcccacagagcaacagttgccacgtcagcaaagctccactcagcccagaaagactacacgcacgcaaggctttaagactgccaccttctttccaactttggttaatttataattttaaaattgtctctaattacctgaatgaaatgtgctccctttaaaacatccaagagctcatataagtaaaatttgggaagacatggtgagcttacacattttctatgcatatttgtatgtgtgagtttatacgtttgtgtgcgtgcatgtacacctatgtgtgcatacatatagaagccacagagcaacttctagctgcctcaggcactgtccattgttatttatttattcatttatttatttatttatttatttatttatttatagacagagtctcttgctggcctggactctccaagaaggcttagctaagcccccggagatctgcccatccccagcactgattttataaatgtgtgtcatcctgcccaagtgttttgcacaagttctggggattcgaatcagctcctcttgttcccaagtcaagcatctgcctgactgtgccatggccctagccaaggatcctaacttcactgctcaaacatacaaaataggacatattgttgtctccatagataaaaatacttcttaactttcaaaaatagatcatacattattttttaatgccctcatttttccatagcatatctattgggtgaatccttaacacaattgatttgctaaagcatgacatgcatgctgcttcctgtttagtgttattcatggattgcagaaaaaaaaaccatgataccatgtaattaatagaagggattaatatgtaattaatatgttgctgtacacatattttttttttcaaaacaaagtagtttggaataaagagcaggtaaaatgttaagtcccctgattcatactgtgttgtaaagtttcaaaacaaatgagaaggaaggaaaaaaatgttcaatagataaacagtaggcaatcatatggcgccatgctctaataataaaatcacctgactgggtagatattaggcttttccccaaatctgtggttttagttgcatttgaatagtgtcttaattcatcctacttccctccctctcccccactttcttcccttttgccccctttccttcctccctttcttccttcctccctttcttccttcctccctttcttccttcctccctttctttcttccttccttccttccttccttccttccttccttccttccttccttccttcctttcttccttctatgaccttttctaaagcaagtattagcacatacattctttaacaagaaagacttctaaggggtgactcttgacagtacatttgttttccatgtatgagatttccctgactgctgaatgaatctcacaaggaatatcaagccaacagatttagacaaggctcacttgattggttggtttcattgcctgtgctttgaatcaggtcccagatgcaaagcagaaaaagataaggcactttatgcagcaggtggcatcggctccccaacgtgccaacgaaatacagtctctatgaacatcacaccacaaaataatatcagtgtgacttacagcaaagaattaggacaggggtactaactcatgtcatgtcactggtcactcataagcatatggaaaactgattgaagaagaactcacatgctttgctagaacaatctataacatgagctagaaagatgactcggttgggagtgttttctcttcttccagaggacctgagtctgtccctagctcacaagtgcctctaattccagctctaggagatctgatatcctctttggcttctgcaggcacctgtatacagatggctcacatagatacacatacacataattaataatacacttttaaaaaagaataatcagtgacatataaaccactccgtgggtatttcccccagtaattgcactcattggggcctttgggtataatagaaatctaactgaaaatgctaaagtagtcacatgtcagagcttggcttaattttttattttttcaccacctgattaattttccttgtctcattcaccccagggtagactactgaatgctagtgaatattgtaaccccagtttatagtcccctggctgtgtattgtgtgtgtgtgtgtgtgtgtgtgtgtgtgtgtgtgtgtgtggtcatagagatggttttgtgagacctaagtcatcacattacccagcaatgactctccaccagtcattctatgctagagatacaagatttcttgggattctctagtcaaccccttcagatgcagaaaatgagactcagagcagagacagtactgggttcaagattacaaatccagcgactgctgggcgtggtagcgcacgcctttaatcccagcactcgggaggcagaggcaggtggatttctgagttcgaggccagcctggtctacaaagttagttccaggacagcaggacagccaggactctacagagaaaccctgtctctaaacacctaaaacaaacaaacaaacaaaaacaaacaaacaaaaaacaaatccagcgactggccaacctacgaggcagtgggtacctgttgccatctgctctcttcagctcctttctcatatgaggatccctctatatagaagttgttcatggtgtggagatatcaaggtgggcaaatttgtcttccccctgaatagtgtaaaaacaggaatgagtcagatctctgagtttataagaccaacaagagggtcccttgggactctgatctcatcatcaaaggtctgaactcttcagcttaaggtcattctaccttccctacaaacctctggtagaagatggtaaaggtactgaaggcaggcctggggtgctggctccatgggtaagttgtttgccatgtaaacatgagggttagagttcagattcccagcttgcacatagtaagtggcccacctgtaatcacagtgcttagggcaagggaggcaatcatccaggcaaactggctagctaaagtagtcacattatcagaatcagtttgctccagattcattgagagaccttgccttcatcagttcatcaagagcaactgaggaaggcacctagcatcaacctctgactgccacactcagggacacacacaaaggaatatgcatctccccatacatgaataacacacaggcacacaatacatatacgtacatgcatacaggcacattcacacacacatacacatgtgcatatacacatggataattatgtattatgtgtatgcctacaaataataaagtggtcagttggagtcccctttgggcgatgtcagaagaacttgttaccccagtaaatgatctctttttaacttttttaaattgcataaatcctgacactagattccaacattagaatccagagtccaacctgtagaacgtgtattagtctatttcaaggttaatgcaaggttctctttgacaggatttttctggtagctttcgcccacaatctctttcccaaaccaaccctataggcatgggttatttctgcccatccaagttagaaagcattcatgcctctccaacacggagttttctttacttgggctgctgataaatttgttggcgtacacactgtagaaatgactgctgtggctattactgtagttgctcaggggagctattcagatgcctcatttattggagcttaatagattaaaagtctaaattgagtctcatgatataagcctaatcaagttctaatctgcataattttcccataagcagcaatgggaaatttggataattgatgtttcagcagccgccaatcatgtgttaaatagcactgttgcatttacttatcaaaatatttttattgatccttacttcgtctgacatttggtttggggattttttttttttccttgctggcattaacaggaaatctaattcatctcctagatgatgtaacatgagatgtttctcttgatttttaacatgtctttatagatcatttttaacggtgatctttccttttacaacttcatattgaatacctgtctcagcaaacctcgatgactgggcctaatttatttccctagtttaacgcagcatatggatttctaaccatcatttatatgcacacaataaaagataatttggctccccctttgagccaattcctttatgttaaatccatgggggtgtgggaagcactcaccttcacttctccatctattctaggggaggtgattgataagaatctccatccccctctctccctgggaaggcttggggatttaactagggaagatttagaaagtactttgtgtttcccccatggaaaagtactgtaataaagtatttattatatacactgagctgtgcaggcagctctaccaaagcaggttaagtctgactgcaatggctcccagtcattgtatgctattgtttaaaagtgaaaacaattaaaaaaaaaagttagcctgacttgtctctgaaaattgccttccaggggttgggagaggggactgggatggagggagagtgagggtgatgtcttcacacagctagggcatggagcacacggttggattagttgttaatgcttggactcttaagtccaactatctggctgtggcccccagatctgtccctttttactggggaaactccagcagcttctccatgtgtctcaggaccattttctctttctaaaagtgatagtgtttactggtctctcaactcctacacctgtgatgaggactaaatgatgtggccatgaaagtgcctttggcatagtctggtgcacagagagaagaaagagttggcttagaggagccagccctgggaactcagtgtggttctgatctgagatctgcttagcaacatgggatgcccttgaccacactgcctaccctctctacaggccatggttaggctcaagcttcctcttcgataaaaccgtgtttgtttagggaggtcttgagacctaggttatgagaacataatttctccttcccctgcagtgtgatcttggtctctttccattaatcccattaccctaatctgtttggctttatagtatccttccatttgctttgagccctgtaagtgtatgacatggagccttcaccccctttcagcacattcagcctgcattgccccacagagctcttttctagtcttctagtttggccgtatcataggtagctggtcacttagatgcagcagaaaccaacatgtttgtatacaacaggaatcagaaacttttctctctttttgtattcttatacccagtcccttctgtacttctttttttttaactcaagggaaactttataagttttagagattataatttaattataacagttctcccttgcctttccaccctccaagccttcccatgtatacacatgtcctccacttgccttcaaattcatggcctttcaaaaaattagtgttttgtatgcatgtgtgtgtgtgtgtatacatatgtatgtatacatatatatgtacatatatatacacatatgcatacattcctaaatatagcctgttcaattggcataatgctacctgaatgtatatttgtagggctgaccattggtactggaaaacacttggtgtgcttttctctggggagagctacttctcatgttcccagctttcttagttgcccatagtctttccataggaatgaggcctcatgggcttgtccgtacatgctttgcttgtcccttgctgccatccctgttcagttcacatgtgggcagacatattggtgagatttcatgggtgtaacttctgacattaccaggagacacaatcacagcaaactccctgatcctctggcttttacaggatttccacccttctctccataatgttccctgagctttagatgagggaggaaacacttttttaatcagtgaaaacattgtcagtgttactttttcctgtcttttctcctagctcttagcaggaatcctccaagtacatgtgtcaaattcctttgttccaagccaccctcactaaagtataatgctctggacttctcattagctgatgcttccccttcctctcttgtccctggatgaggcctcacttgtccagcctatgagataaccaacatccagagaagaaggtcagctgcagcggctgacccggctcagtttagtacagtagatgcaatagagatgatttcactggaacaaagatgccataaagaaacacagaatgatgataacagtttcaggagttccaagaagcaaatgacttccagctatttaaggggaccagaaatcagatctagagaagagaaggttctagtaagggcctacacttgctaatttgaattaagaacctttcctgtgtgaatgctggtcaccagtttcctataatcctgaagaaaaccccagccttcctagtgtccaaattccttcctgagaagcttctagctgtatattattattattattattattattattattattattattaatcatcaccatcattgtcatcatcatcattactattgcagaaatgatctatttataaccaaaacatctgctgtgattcttggcttcttattaattttctgacttttttttgtgaaaattctttttttagaaaatctagcaaaaaaaaaaaaaccaacaaaatctatcatttctttatccagcataaagggtcttgatgggtgctggacctctctaccagtatttgttgagtacctcatataatatagtctttggtagacagcatttctgagtgtatgcttcaccctagttatggcacatttcactttagccttatagattccctgtgtaaggatgcttctggtttttagatgaagaatcagagactttggagagaatactggttactctgtacaaggctaacacaagtcataatatataccatcctctctaagacttagggggcgttgtggaagaggggacagaaagaatgggagagcctgaaaataagaaaggctgtgaactaacatctttgcaaaacaaggccagtgcagtcccagattcacaacaggagcagatgcctgtgctaagtctatataagaatggaccaatcaatagtcaggcatggatggaggcggggcttgggtctctacctccctcttgatggaccaatcaacagtcaggcatggatggaggaagggctggggctctacctcaatagtaaatgacttctggttgatccaatgagaagaggaagcatagccttagtcatgtaacccctgataacccaactaagctccaatggacagtcttcatccaagagtcatgcaggtgaccctgattaaactaaattggtcagaaaataaaattgaaagtcatgaatcctaggatgggatgaaaaagcatcagagggagataagaaatggtactggggaaagtaatgaaatttgcatgcatggaatgatatagccagatgacaaaataactaagcaaaaatttttttttaacatttaacagactctggagaaagaaaataacagaatttggacctgtaacttccagtttcaagtctattttcttagctagtcacatttgtttgtttgtttgtttgtttatacaagtcaagcctgttttacataagctgaaagttcaactaagcagggaattccctggcctaatatacttcctactgcccatgaaatgtgattgtccagcccgagataatgccagtaaaggtggtggttgcttgatgctaagtgaatagcagaaatgataccagtcacagctgccactgggattcaggacaggggacttccctggaaggagaggaggtagtctgggaaaaggatttctaactccatggagaacaatgttaacatattaaagcaaaaacttaggcaagtcacaaatttaagatagagccttttctaagtaaggtttcttcctctagatctctaacactgacaatcttagtacttttggcaaaataaagggctgtctcccatgttggaacatttcctagtttttctggtctggctgaagttgcctggtgtatgttccacatgtccaggcttgcatgtccagaacaccagtgttgttctatgtaaagatgtgaagggatcctgaggataaaagggtggaggctggaacactgtgaagatctgcttcttggtcaaccatgacctgatgataacatccaaaggtatcctcctgtctcattccttcaggtgcaatacaccaggatttctcttctcttcaagtttatttaggggagctgcattagcctggcacttcagaccatagttttctatattagggcccctaaggaggaaaaaaccaatgctaatcaagtctcattgctggtaatacaactatatgagacaaagggaacaaatccatactttcaaaattttgtcctacctctttaaagtgtgaagacagaaaaggagcaaaataggaggacgtgtggtctgcctggagctctcttgttaacattactatcctgttcttgggctcccatgtgaaggagagagagagacctttagtggaagagtgtctgtctccccatcacaccttgtaaattgcagacgctgatggaaccagccttggtgactatagaggaaatggagtgtgtaagtcaagtgtaagaggcctaggagacaagtaccccatttctaaatgaacgtttcacgcaaagaaactgagtctttccacagctgaaaaaatggaatctttaaataagataaaataaaaggatgcttttggcttgttgcaggctccgaaacaaaatacagctttcctaatactgtatgacccgtatctctgcctgctttatgggcgctactctttgaggtgcacacccatattttctcaagtcagcatttgatgatggctgtcaaaatacaggccatgtattatgcatatagcattaccgatgtaaggtgtttacttgtcaagttgaagaaattcaaaaaatgtcacatccacggaatctgcacagctgtcacttgcaatttttcatgcttttgaatgcaacttctgatgaaaacagtttatttcttccccttcactgttcaaagggaaggaaacagctagcatttaaaatgtgtgctcctggttatgcggttggctgaaaaacagacagattccgtagtttaggaagaagaatgaacactaactcactgaacgtgagttggtctgtatgaggagaaataatagtacaaaaataaaaattaagtgcactcagggactggaaactaagtagtatttttgttctttttaaagtttagcactcagtagaacatttatataaaggagaacaggaaataaggagccctgtacatgtctctggcactttgtgcttatgaaccttccaagggacatggaattcctgagcgctagacatccccaaatgaatggcagcatcagcccagcccttgtctcattaccaaccggtgactgtctgcaaaatgtggtcctttgatcaatttgcaacttcgatttggaaatgaagccaagtctccttgtaccttgaaatctctcatccgttggtaagcccatacagagatgagaaactgaggagtcagggatggtgttgcgcacctctgatcccagtacacagtaggcagaagtaggtggatctttgtgaattcaaggtgagtctggcagatataatgggttccagactacccgcggccccatcttatctcttcaaaaatgtgttttaattaaaaagatgaaaaccagaaaacaatccaaagtgaacaacagcacaaggctgacagctgcagttgctgtgtgcttccaatggaaagtgattttctaaccaatgcaggcatgatacagagaatgttgctgtctttgtctgcatccttaacagagcacacagtgggttgggctggaggaagtctcacctttactagacctggcatcccaaatcttaaatctttttttttccataaatctcatgatttctcagtagtgctgggttagttacctcaggaactcaaggatagttctagtacttagttcagacagtatcagcacattacttttgttacttcaacctcgtgcaaagattgatgtccggggtgtaggatctgcaagccaatgaaacagtgtcctgggggaatcaaaagagttgaatttctatgcatttcttttttaaaccaaagaacaattgctgaaagcctctgggctgaacttcctcactaagcagaaggacatgcaatcagccagcttaagagaacaggcagaatgggttgagataggctgcagtaacaatcaacaaaacatttctgagatttaaaacagcccctcattctctttcacttagaatgatttatgggtcagggcagctgtctggactccatctccatagtgacccatgtctccatattaggtgtggtttgggaagagaaggacaagaccaagtcatataccagacatgatgtgtgcttctttgctcgctttccattagcaagagcattttgtatgtcatatagtcattcctacgtaaggacaactaggcacaggagaggggaaactgtaagcagaataaaccttgacatggtctggacttttaggaaggtgtcagagtaagaactgcttcaagtgactcttctgtaatgtctaaacaaacaacaaaaaacttgctgactttatcccgtgttacttggtgacttgtcaataatgtgtacattgcgttttgagggttttgtatgtatactatactttttatcaatgccagtttttctactcctctgaatttctccccactaggattcacacctcctggaatggacagatcatcacccgacaacagcccagtgcacgggatgttacgccagccgtccatcacaactggggtcaacattcccatcatcacggaactcggtagggggtcactgtagctcactgcgtgggcgttctgtctttcagaccatgaagaaagtaaggagtttgtccagttctttagctttttaggcattgtaggtttctgtgggacttaggggggaatagtgaaggtgaggtttgagtagtgatatggcaggttatttgaaggaaaaaaaaactgttctatctttctcaaaagacaaatagacagttttcttcctgctggttcctgttttcaaaggagcatgagaatggctttgaaatcggggcatccatttgggaaggggaaagagaagaggcgtgaattcctcttcaggtggcttcttcttgaaggcccctcttctgagtgttctgtttcaaaggctcccacagttgcaagcctgctcagaacctcaggtctaagcccttcccacctgaaaatggatcccctttgaggatggggtaacatgtctgtctgctctgctatgtggcaaccccaccttgaccctgtcctagttgagattctcaccaaaggtcatttttagccaatgaccaaaatatgaatggggaggggatttgtggggtttgaatgctgtaatctgtagccaatagaatccaacttctgacatgcccatgccattctctggtagcctctgtgaagtttaaaaaaaaaacaagaaacaaaaaaatactgaatggctcttcccttgagacaatacagactctctattgtccgggtggcttagcttgagaatgctgcctctgtttttccctcactcttttcttcttttctgtactttcctccactccctttccctggacccttaaatgctgtatccaattagctaagccgggcaagttgcctttggtatcagtcaatcaggaaaaaaacagtgggacgcacattctaatgataacggagttgggtaagaagtgcttgtcttctttgacatcagtattttcttttgttctgatcttggtgtttccgactctcattggctccccccacctaccccctccatttcgctggctgtaacagcaaggctaccccatggcactgctttgaatgtgttttatttgtggctctggttggaatcgactgtattgttctggcctctcttaatgattttttcccccacacagcatcagtaaacctttgatcacacccacctgacctggcagtagccgccaaagcatctctgctctaattcattttccgtggcccaagcctttctctctccctttcttttaaatcccacgcgtgcccactctcccctgcctcctcctggcattcctcttccaacttgctgtcagtttgactgacatgtcttcacagctctcagaggaagtcaaaggagaaatataaaaattttaagataagaaatcctagacagtgccttccctccagctgtttatttttctttattctgactttatttgccttttttccccctactaggccctctctcagaagttctgcctctgaagccataaaaagcagccagttcccaggggatcttttcttactcaagccagatttcaagaagggtgcagaacaggctggcagccctatactcttacccccaccctgctggcccaaagccctccctgggaggttcacagtggatttatctcaaagataaaggcccctggtcatggctgcatttgtcagacccctccatggctccccatgccttggttaataacccacgaagggcacccatcagcagcaggtctcacaactggagattgctcttctaaatagacacagcaaagggcttcttggcagagacgcagcgggaggggagggaagcacctgccttcacaggactcacaaatgaaacgaacactccattttcttggccccccaatatatttcaaaataagagaggaggcttttaacacagaaatcttgctcgtgaggtgtctagaaaccaaggaataaattgtccaccatgcagccccgcgttgttgttagacagagctatttatctggacaaattcactcaggtcaaggagtatcacactgttttcaacaatacgataggtgtctttttcatgtttagcgttgttggctaaaagcctgggattctccatcgttcttcctagaaccacagggccataaacgaccaaggaagctcgtgtaccccagacgactgttttgaaaattcattgaacatctccaacacagatacccacagtagctttctaaagtacccatgccaagaatttctctttttatttagaatctgtgtgctagtagctgattagaatatcctgatttttgattagaggaaaaggaaaagcaaaaagcttgaggctccagatacaaggcagtaatttggttattgagtctcctaaccctctttcagaccagatttttttttcccctccaagctttagggtttgggccacttcttcctcctactctcagggctagcttctctaggaaccataccactctgctcatacctagcctcctcccacttcacccctgcagatattccccctttgtcatctaccctggcatgtgtgctctgttgtattgcctcagccatttgccccttaaaacacacagaggcaggcaggagagacgggcatggggtaaagtgctggctgtgcaccaggaggccctgggtgctggtcgcccacatccaagctgagcttgccaagggatgtcttgtcattctgaaagtccttatagacagacatggaaggatcccgaaggtttgctgcccaggtagtctagctgaataggtgaacccaaaagttaattgagagcccctccctcagaaaataatgttgaaagtgattaaggaagacaactcatgttaacctctactttccacatgcatacatacaagaacacatacatacatgagcacacacaaaaacacagaggcaaccaaggccaaacacattttaagactgtcctcatccatcccaatatttccatgataaaggctcctgacatttccatgagaagtaaaaaccaactttgtccgaagccatttaacgggctacttcccagctctatttgatcacctgcattgtggggcaatgcacattatgtaattgcttattgagaatggcgtacattatgacctatgtagtggctgttctgggaaatgggcccaggctgcatgtgctgttatctttctaagactggtgatcccagaacaataagcaagcttttcactgaaacgtgactcacaccatgacattttcttccaatcctacatccttagattgctcaacatccatagctgttccttctacttggggccacacaaaagtagcgctgtctcttacccatctcctcatacacaaggaagagatactgctccacttgaaatgattgtatagccaccatcagctgctgctgtcaacaacgaaagtaatatgccaatacatgtgctctttttttctgattcccagagcagaaatactgtgatcattacagcatgcttttggaatgtcagaagatacaactatagacttgggacttagtttagttgatatgaaatgcttgcctaacattaacaaagtcctgggttcaatccctagcactttataaattgcccacacagtaccatacccacaatccctacactgcagaggtgaaaggagaagcatcagaagttcaccctaatcttccactatataataagtttgaagcaaacctaggtgatatgagacactgtcaagaagaggggagagacagagagacagagagacagagacagagacagagacagagagagacagggaaacacagagagagagaggttttgaaaatgtttttaaaatatttattattcctattttatgtatatgagtgtttgcctgcatatatgtatgtgtcttgtgtgtatgcttggtgcctgcagaggacagatgtgtatgttgggctctttggaactacagttacaggtgagctactgtgcaggtgctaggaagcctacacaggttctttgcaagaacagcaagcgttcttaatcatggagccatctctccagtgcctggtttagaaaccttaatcttctttatttatagttctagagtatggcaggaacccataacaaaatggttccttatatttggcccactatgagagcagtggtgtgtgtgtgtgtgtgtgtgtgtgtatccatctccacagaaaaaggaagtgaaatatgagagaagaaaatgagacatggagagacagtctggctagaccaccagtggagcttgtcttgttctaatctagtttgaatacaaagccacttgtgattggctgatcccaagctacttattataagaatttgttatatcatttccacatgaggtgaggcacatgaagttcaggacttatacttttagttgaacatgaaataggtatggagacagcttagggcctatcataattcagtttaacagaactatttggagggcccataagtaaacctttagtgattctgagaggatcagagagaggctggatatttccataatgtcatggattgatagacaatcaagatgccagtctccatttatccagggcatggcatggatcacatatggtcttcctcgtaggctcagagctacttcttgagagactgcagaacttttcccgttttccagtgagagcaacttggctgcagggtcaggaaatgctttgtcaaaaactcagtgacaaaacaagactggagacttttgcccactctcctacaattcgattgctgctaatacaactgagacccaaatgtgatcaaatttggaaaaatcaccacaaagatttgcctccattagagtcattttctagggtggcaaaaaaagatagtgccatttaaaaataattccacgcctagcctttcatcctattatcatttattgtgactcatgcaataaacaaaagggtttttttgttattgttggtttaaggaaagttgtcaagaaagtcctttaaaaaaattaaaacaataactctagggaagagaattagctgcagatagattcagaaaaagacacagaaaggaaacctcatctgttctcttcctaaaactgccttaattattccagaaatcacaagtgtacctctctccaacaccccacacttccctctattacaattcaaaattgatcatttatgaagccaagataggaatagaagtgaatttatcatttaatttttttataagttaaagacatcttacttatcacccattttctaaattaaagcacaactcatcagtctgtgggtgtatgcaggaggagtccttgggggcctcctcagatgacaatgaagaaagacatcttgccctggccatgtcttcttctagaacacagagaagacagagctgtttagagggggaagcagagtgtggggagatttgcagaggaagtcagaaaacagcaggaggcatcccatgtgttgagtagaacccattgagcatgggcctgaattcagagaagaggcacaccgggtcctacacaggcccatgcttggggccacctctaggttctgcctgaggataaactgcttgccatttggccttgctgcatctctgatccattgcttttctttctgcataagttgctttcttttctctgtggctaaccttaccatcccagcatggctactcatggctatgtccctctctcagaggacttggctaccaaaaaatgcctgagggtgtttcttggtcatgattctaaaactgtaacaaaggactggtcaacttgccatccacttgccagtccttgacagttgccatagaacaaacctgcttgacctcattgctctccaggtcttaggaattaaagcaatcctgtaggagcaggccacttgatcccagtgcttgccaaccccgggatccatcaatagcttcctcatgctttttttcttttacagtaacttaagtgtctctaacccagtcacttaactatctctctggcttcactaactcttgtgtagtctccaaagctaattcttattttatgccttttctagtgaatgataccaatgttcagtttttggaccaagacgatgacgatgaccctgacacagagctgtacctcacacagccctttgcttgtgggacagcatttgccgtcagcgtcctggactcactcatgagcgcggtgagttgtctatcttctttctctccactcaagcggtggggtacacacccatggactgtcttcacagtaggagatactggcaggaacttgaactgtgcatggaaaagagcagaagttcatgaatgtgtctctttagaaaggacaccaatgtttatcaatcacacaagtaaatattataaattcctcaacttgcaaggaagacatggaaagatatggcctggtttggaggataagagaaacaccacttaaggaaataaatattttataccaagatgtgagactctctcaaggaagacaaaggaaactgaatcagaatgagtaaagaacagggaagacattgaaaaccatgttcatgagtctttggacttaatactgaagagtgatcaggttcatgtctgaagcgcttgccttatctatgaggtgtcttggtcaggcaagattgggtgtagtgtccatgtaagcatcttttctagctggacggagggaattctgatagtgatgcaagcaggtgggcaggtctgggcactcgtttgtacgacggggaacatttgggaatagcctgaatgtgaacagaaaacagaaaggacagggtgccaagggagacaccagcatccctgcctatcactaaaagactagaccttaaatgaggatcaggcacaaggctcttcccagctgaagagcaaagagataatgatggtaaagaggagttgttgactaagacatcaaaagcagttgtttttcccttagtaactttatgtgtatcaagtggtcaagccttttaccacccccctttgtgacccttcaaataagcaacaactaagaaagcacattcctgcatagtggcagtatcatccactgcagcagacaacagcaactgtttagaacaggccacagcaggtactgggagtacttcccaatagtatctttctttaccagatagacaatgctcttcattttgcagtagtcaaattcacagtttgtgaaaatgagggtgggcgatggataaaaactgacctttgctgaatccacggaacagggttttattgagcatgttaaactacaaatataactcggaggaggtttttccatacatattctcacattgctaagaaaggtcattctcttgattgtgttaagcaacttacattctaattatgcattattatactcattcattaaaaatgaatccccaaaggattactgtgtaaggaaaagaggaagacatgaggctttcagagatgtatttagtttattccttattactgaacatagtacaaatataaacatatcttagtgaaatattagagttatggttttaaaaataattatgacataagatcacctgggttaaggttgattggtggcttttgtagccagtaagaagaatcgctgggccctatagaggggtcctcctggtttcctgggatactgtgactgacgttggagctgctgctaatgttggcccagtttgtacaaactcttgagcaggttggaaagaacaataaacactgcttgattgggttcagtaaagcaccaaattctctgtaggaggccagatctcatctctttagaaatgtcactttaattttgatcctaatttcagtgattttagaactctgatcttactgacatacaagtaagctgtttatgagaatttttttttgttttgttttcagaagagaaaataccattaagagctttttaaaactcaaatttataacatttgtatttctaggcagtcaatgtgccccaggtcggatcagatacatcatttataaagggtgtgtttttataaattactgggaattctgaactagtgaagctgtacaacagagcaggccaaatacttgtgaagccggtgatgatctgaagctgatgggattgaagcttctgcacaaagggacacgtgattgacagcctggagttggggcatgtaacagtgtggaatcagggcatatccgcatatgagttataagactcaccattgaacagcatcactagggagtcagttctcagaaactaggatgagaagttgaaatgaactgattttgtttgttttttgttttttgttttttcaagacagggtttctctgtatagccctggctgtcctggaactcactctgtagaccagggtagcctcgaactcagaaatctgcctgcttctgcctcccaagtgctgggattaaaggcgtgcgccaccactcccagcttctaatcactgtttttaaaggtcatccatcctcaacctctctcgatatcaaaattgaagtgttgggacaaagtgacttgtgccacacagatgtcatagcctgtaagcagtatttttcctgcatcatagcctagagaaaaatcaatctaggaacttagtacttgtttttcatgtttcttattagctgcattggttattgagggcctagaactatgtaacacttcaataacacagtctgatcttttagaccacagtgtgggagaaacaggtttaggtattggagcaaggcatatcaacaggcccactgacagtgtcctttcctgtcatcaatcaaaatcctagccaaattattccagaccttgctctgttatctaggatgaaaaaactccagttgaggtctggctcaacacagacaattagatccagaccctttgacaaaaaatgctacctgtgatgtctttgtatttcacgccagccttcatttatgaaaaagaatgtagtttggtcaattaccaaagccctaactaggaagagctaaaatgaggttccaccaaagagcaggagcagaggtaagacaaccacagcctccatctgcaggcaccatcacaacgcctaccgactttaaagcacatggagtaactgggacagtgtggcacagggtcaaggcaacctgaagcgtctagatctgattcaccaccagcccttgtttatcttttccattgtctggaaatcagttgagaccaaatgctaattaagcgtgatgtgaacaactccttatgtctttgtagtacttggagaaggacaaaggaatatgaaggtctttcaacaagcaggcacatgtgacaacagagctgtagatgtgttatttacatgcctgtagatgcatatatatatgtatatatatatatatatacatatatatatatatatatacatacacatacacatatatatacatacacatatctatctatctatctatctatctatctatctatctatctttatctgattactcattctgtctcctgaacacatgcgtgtactcatgcttaagaacaaaagttttcaacctatgtgttgagattcctttgggagtcaaacagctctatcaaaggggttgccaaagaccattggaaaatctagatatttacattatgattcataaccgtaacacaattacagttaggaagtagtaataaaaatgattttatggttggagtcactaaaacatgaggaaatatagtgaagggttgcattattagacaggcctagaaccactgtttagagagataagacccgggagcttttagatagatgagtcagaagtctgtaggagagatatgtctgtgttttcatgtctcatatgaactggtctcttgatgtcagaaataacaagatttgtattactaagactggaaaacatgttcctctgaaccatgggtcctcctcccctgctttctacctgtactataacttcctggagtggggcaaaccctgggtgagccttatggtgaaggctgaactgtcagcccaggataagctgctgctcttctagagatgccagctatttactgctcatgatgcatctcttatactccatccaagagcccccgtttcttctgctcacaagcagacaggcagtccgcaggtgcagccagggcagatgggctagcagcagtgttatgtctgagcagcaaacagcaggatattgtgctggactcaagaacataccccttgctgctacaccaggcaaggcagatccaggagaaaataattgaaatagttctcattgctcgtgaaagaaaaatactaaaaataaaaaatccacactatgaaaaccagcaaatataaaaaatggcagatatgacatggaaaatgacaattttagtgcaattatagacgaaaggcagagtgccattaaagttaaggcaatgttattaaaaaatgtgttaattttcagttaaattttctataaaagaccaattagtttaaaaggcttgacagcattaactgtgaaacataagctccagtaattatacttaaaaaaaaaaaagtagagagaagatgctctagtgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagtgtgtccttacaagacccaagagtcactcattgctagaggtcaagggaacctcacacatgattgaaggcagccctcccttattagagatgagaacacaggagcagaaagtatgggcatattctaaattggctgcatcgggagttaactgttcttttttataaattataattcattgagtactggttgcatatgggaaattacacaaattgtcttgtttaacactagtctataaatttgtgtttttcttttttcttccctattatatggatgaggggtcaagaccatagaaaacttgggtaactttcccattatcatagctattgagtagccaagaaaggattaaagattatactgtagggcatggtgagatggtttagaggcaaatgcacttgctgctaaatataatgacctgagtttgatccctaggtctcacatgaaggagaaaataaactcccccaagttgttctctgtcctctaccagtaccccatagcacacacttacacacaaataaataacataaaaaatttaaaatctcataatcaggatgacagcttactctactacaaagaaagccttcccaagaaagtgtcttcttctcttcccaagaagcggcctctgaattctttagactgcacaggtgtcctggctgcaggtaacaaataagaatcaagttcatctcccatttgctccccagccaccaaagtgacacaggattgggcaggacatctgtgaataatcttttcagtctacaggtttcatgcagaagagtctcctaaggcattcatcacatctgtcatggacttggttcatggtggggcataggaaagtctggagagtgtaggagcacaagagacaaaggttcatgcatgcccttcacagtctacaaatcctctacaccagaatattcattaatctacaaaataattgtacattctggcttctttatcttctgcaaggatagtctttgatagtatttggagtcctagtgtgttttgcctcatgatactgaaacagacccttcctcttcacctagtcctgtatgaaaccttgtcacctactttcaagctgaaccactcatggaccattttgagacactgtctttgaattacatgtaaatgcaggcctggagactattgactactcaattagtgccagtgtctctgtataaatcatttaaatacatgctgaggtaaaatcccaacaattcaaccaaactacgtccttccatgtggaccttatctgtatattccaacaggtaactctaccatactcattgcttaaaataaacagattgcagtttccacatggagatagatagccacttttcttttggaaaatttaggaagcacaagaatatagaaaaatattcaagtggtttgtatttccaagactaaagaaaagtgtttactattttggtatgtgcaaatatatatatgcattttttatagatagataggatagacagatgggaatagatatagacagacagacagacagacagacagacagacagatagatagatagataaaaaataatagctaaaacttccagttttaaatattggttaattatttctttttaggtaatattttgttgagagaatttaacatgttatttttttttaaaaaagtcacaacttgcaaagctcccataggatttcgtgatactctcttttaaaatagaccacaatcttttactttattgaggggtagttttaagatattttgctacaataatagtcccttttattagctttcaattactataatagatatctgaaaaaatctacagcaaggttgatttcatggttttggaggtttcagcccatgactggttggcctggctgccttgggccttcattgggctttcactttggtatgtagcagaaagagattaaaatcccacagtgttttgaaggatgtgttctcaatgatgagacaacttccctccaggcctcacctgttaagggttctaccacctctcaatgcaccaagctggagaccatacatgggccttttgtacacattccatatggaacctttaacactcaagggttatgcgttttgtacatgagtcttggaatgaatagcagtgcatttgtttgaggcaaacctactgtatgtcgagcagatatgaacatttgtgaagctcatgatagcctttcctaattatctccccagaataagtgtgcccacacgctcctatcatgggtatgcaaatgccatctcatgtctgtggtattctgtgctgccatttgccattttccctaggaggacctttaactgtgtttatgatagctttcaatatatacactttcatttttagttagtcctgtaaattttatatatatatacatatatacatatatatatatatatatatatatatatatatatatataaaattttcttttgataatttcagtttttatccctaaagacttcttgctgtataaaaaactatcaaaagagatgaataatttagttgtatttttaatgtttttgatacttcctttcctttttgagaatttaaaatgaacattttcacagtagaaaaacctatgaaataaataaaatggaaatttttttagatcaagaatttgtttttacaaaatacagatgtatctgtcagttcagatctatgtttttaacataatttttaatcgtaatgcatatgagattctactttaaaaacttttaccaaaatgtatttttgccatactataattttctcaaaacatgttaacatatgcacaatatacctcatataactgttttgttattaattcaatcattgttatagacagtttcccccaatccacgtgtggagaaatcacccttgtccagtgatgtgtgatggtttctggactggatcagccaaccttctctgtaaaagcctggatgaccagacttttcacttcttaagagctgtagtggcagccatggctacttcccttagctgttgttatcctgaagtaactgaaagtattacataaacaaatgagcatttctgagtcccaataaaagttaattaaaaaaaaaaacctgacagtggctataaccaaccctgcatcttaataattataaccactgaagtatgcattcttgttgatagaatttctaatcctagccatagtggccagaaaaagtttactgtaaaacttgagcggaaatataaagctctctccaaaagtcacttaatgtaattgtatccagttgtcttttgaagtccatgtgaaacctacagttaggtacagatcaaacttagctgactaggtgtaaaataacaagtagctctgtcccatgttataagaaacagaggtggtcttttttccctaacagtctttctttgcagatgactcttactgtggttcatgctttagagcaaaaacaattctttgtaaaatatttactcagttttaaaattatgagtgtgtacatgtcattgtgggtaggcatgtgcatgtgagtgaatttgcctgtagaggtgtgggtgatcagaatccaacataggttctgagtagtacatgtctttaacaattgaacaacacctctagtccccacacatgtaccattattcatgtccagagactggtaataaagagattgacattaattattttatatactttggatgatattctccttctaacttatgatcttattgttgttgggatattttttcaaagcattatttctaggctcatcaattcattaaatatcctcttgatagttcattgctttatggcctcatttttcatcatgctactcaccttaggaaagcataatttaaaacacacacacacaccaatttatagcatagatttattcattataatgcttttgtcttcgaactgcttttatattttcaggtttattcacgacatttttttttttgcgtgtcataatcaaatatcccttatatttaagtagtctctattctaagtttcacttggatcttcatctgctgctagacattcagcatatttagacccatagttcttaacctgtggatcaggacccctgcagaggttgaatatcagctatcctgcacattagatatttattttatggttcataacagtagcaaaattacagctttgaagtagcaacaaaaataatgatatgttttagactcaccacagcatgaggaactgtagtaaagggttggggctttaggaaggctgagaaaggctgatttagaggatcccctgagacattgtgtagttgctattgtttgttacattttatccataaatagttggagctcttttgtaaatgttagctattatcacaatatactgaactcagcatattttagaaattttcttataatatattttgttgttctgttcattttgtataaaaatactaatatggcattaattttgttttacaatagatctgaaaattctttgttattttatagattctttagctgattatgttgttatactgtatataactacatctgtactttattattaattattattattataccttttctttgattctatgattaccttttaccattcatcttttggtatataggttaatattaaatgcttaactgtttatgtctagtgatgcttaaatttgtaaatagttctgtgtttagctctagttagtgtttaatggtcccctctataaatacactcaaaactgatattttaagtattaatatctagaaaaccttggtatctcttgtttttctccttgtataaccagttttagtgtcattacttcctctccccacccttctatttcattttttgaattataacattcacattgtactaatagatgattttatgttgtcatttttcttttcagaattagttttgacatttgtactcagttgtatagtattttgtttgtttagtaaagttttattttctcaaatgtacatttgattgaccctgttcatgcatcttcagtagcagctggggcacctccaccctttgtgtttctggtgtgaatgacttgggctctgctttgaagccagcttgataagtccttcactaggcatctcctgaaggaagggctgccctgaccaaggagctgcgaatcttcagtctctcagacagcacagctggagaactaagcttgtagctgggtacttccttacagagttcatattatgcagatttgtcaaacaagatgagattgctcagcttatccctagccttgcccttggaccacttcctttttgccttgcaccagttttatttactgggtttttgccttttttggctgactttctatcatctttcttcttgtcattcttgggcagcacggtgaagctcaaaggagtatgccaccactgcagcatcactaagatatggcgggaaaaagctgcactgttttttaagtgacaagtatgacagccttttgtgcatttacatttgcacatgtgtgtgccttcttgtgtgtgaaagaggctaacagtcaatatcatttgtcttctattacctttcacctcattttgtgagacagaatctccaactgacacaggatctcaaggattccaggaactgggagcatgggagctttggggtcatctggttttgtcttctcagtactaggattacgggcatgcaccaacacttgtctttttatgaggagtcaggaatctgaactcagatagatcctcatgcttgtatggtggatatcattgactgagctgtttctccagcctcatgacagcattgcacagtcacatgtcttgatatacctctccagtattttcaaaccttttaaggttaaaaaaaaagtcaaattgtatttaagaaagctagtttttgcttctgagtatcttttaaaaatcaaatgaatagaaatggcaggctggagagttggctcagcagctctgggcttcatactgctcttgcagatgaccaaagttcaattcctagcaccctagtgaggcagctccaaactgcctgtaactccagctcctggggtccagcaccctcttttggcctccacaggcacctgtactgtatgcacaacccctccccacaatagtctaaaatgaaatcatctttaaaaatgaactgaataaattcttcagttctccaagatccagaatcattccaattgttttcacaaattaggatgacagttttatagtctatagagtccttggaacaaatctgtcctttcaaacttagttggcatttcgttcacatttgttatgggagtcccatttacctaatgctgttccttctctttttttctaagaataggattgctagtcactttctttcttcatttaataatttaaatccagatattcactgggcacagggcttggcatgactcttgtttctttggtgaagccctgggtctgcttcttaggttcatgctccattttaggaggggtggtgcttgtgtgatgaagtgctttcttgccttagtttcttgaattatttacatgcttttaaaatatggcactactgtttagcatatccatcactgtcttcagaatttgtcagattctggttttttttctaggacaataaaacactccccattactctctctctctctctctctctctctctctctctctctctctctctctcacacacacacacacacaccctctctctctgtgtctacatatgtgcccatgtgcatgtatgcatgtgtgtgcttacatacttttcagttttacagcttattactccacagataagaatttagccattacaaacataattatcttttaatcatgtaattatcttttaaccagttcttttaagaagtgttttattagaatattaatagactataaaattcacccaagtaaacagttttatgttttttaagcatatataaacatccccaagaatcccttttagaacatactcataactttcgagagaaatctgtcctcgttttccttactactttagctacgcagccctgagcacccactgatatttatatccatctctctagaattgactcttttggatgtttcatataaataaaaacttactttgtttttatgattcatccatgttgtagcatgtatcagtgctctatttctatttatgcacagataattgattccatggttctaacagttggggatgcattcactagctgattgccattttatttgtttctagccctttgtgtcaatggcaaatgatgccattatgaatttctctgcttgggtctttgttctgatgtgtatttcatttcccttgggtatggttagggtttgtggatcctgtggtaactcgaagtttaccaactaaggaactcccagacaggtttccaatggttagactgcttattgtcctactggaagtttataagggcttctgcttctccacattcataccagttcctgctatctatctgtctcttgttttatcacagctatcccattgggtaaagacaatctctcactacgactttggcttgtgtcaccctgtggctactgatcctgggcctctttgggtcttttgatcacgtgtcaatcttgttttgaggcctcatcctttttctgtttttcaaatttattgctttttggtagttgtgttattgggggactttaaacacttgatactactcccttataaaatgcacttttctccaatatttttactaattttacagagagtttttactttctacatactcttcccccataagtttaaaatattacaagatacaaaaacattccaggaatgttctggaactgtatcatgtttatgggtttgctcttattctaattgtatcttccaatccatgaacatgggatatctttccacttatttggatttcattcatatcttttgtaattatatatagatttcagtacaccagcctgtgaactccttgaacaaacttcttctgaagcatcttccttcttaagttcttcttgtttattgaaagtttataggagaagggtttgtacatttgcttgttgatttttgtaccctgaaatcttcccgaactcctattacttatgatcatgttagtgcgttccttgggactttcaatacagtgccatgccacctgctaatgcacataatcttcattcttttccaatgtgaatgcctcttttatttctttcaaactggctagaacctccagtgcaatttaagattaaagtcatgaaagtagttccttttgatcctaattataaggggaaaacatctgccctatatgctccttagtatatttttgggtttttttttacccatatgtatgtatgcgtgtgtgtgtgtgtgtgtgtgtgtgtgtgtgtgtgtgtgtgtgtgtatttatatatatgcatataatgaattgtagtcagttctattcccctcttttcatttctctgtcccactgaaactccttgtctccatagttctcacttctacttttccatgttcattttgtctgtggcccactcagcttaattagggtttcttacccaagcttgagtcagaggatatttactagaacaaggacatttgcctgtggctacactactgaggaaaatgatagcctttcctctaacagtttttaactgccaatcattcctacaggaggggtggggtctctctggttcctccccctatccatgatgaaatattatttgactcaattttgtgtagttcttgtgcagatgactatagctgtcatcaataagtgcattgaccatgttacatctagaaagttttgtcctttctcgttccctgagcctcggaggagtgttatagttgtcccagtcagaccgcatcactctactgttgcttactttctggtgactacctactcaatcaaacagattcatctgcattttatcttgaaaactgtttccttctgaaagaaaaaaatgtccctcatttctttatatttgggtagacggtgtgtcagcaaacggggttatgaatgtttgccatctatgtacctatggttggatttatctcctggccagtggtctagaatggtgattggagcagagaggcacctgtaagttttgtgttcagctctcccttattcaccatggtagatgggactcgggaggatattcctctgcttctgagggcaggggatcagactatagggaaaactttgggaaatattaacatgccattggtaagtgtaatcaggctccagtatgtagtctacaggaccttccctgtgctcttccttagtctagagcagcagttcttagtctgtgcatcacaatctcttcagagtcataaggcatatcagatatctacattatgattcataacagtagcaaaataatagctatgatgttgcaacaaaaataattttatggtggggggggggttacaacaacatgagcaactgtattaaagagtcccagaaattagtatggctgagaaccactggtctagagagatcttgggcactgaggctgatagagataacaggtacaaggaagaaggacaataatggccctccagcttctaggacaaaaactgcaacaggaaagaactgtcaagggatatttggggatgagagtgactgtcttctgtcatcaacaacagtccctcccccagtgtctctgggatcaggtcagtcatatttaccagcacttcctggaccctgagtttctcagtccttcaggtgctaagaattgggaatcctatatatgctctgatattcaattttatgtgtgatgacactgagaccaaaaaggtccagaactctctaaggccacagcttctgagaaaagcattccactatgggatcccgatcaaaaacaaaaacaaaaacaaaaacaaaaacaaaaacaaaaactcagaggatttggtaagtatgcaaatactgccttgcctctgtgagcccaagcatcaaactctgactccaaggagacaataaaatgcagtggctgggctgctacccaaaggagggcagtccctgagactccaacccccttagccatcgcatatgcatctgctcccttgggtatcctaagctctgcttgttcacaccagggaacagttgaactatgagcatacattctcagctggatagcctgcgtgtaactttaccagcattctttgcagtcagaattctatgtgctcttcctttgagtgttttaataaggaacataaacttaatactaataaccatgctgattcaagtgactgtaaacactgacgctcaggacaggatgacacaaagctagtgacagagtgagaggagccctcatcccagtctgctttgttctcagtgacccactgtcagctaaactttccaaaaagttgcaagttgcagctaaggatgcacctgccttttctttctttctttctttctttctttctttctttctttctttctttctttctttctttcttccttccttccttccttccttccttccttccttcctttctttctttctttctattggttcaatttcttatttttttttaattaggtattttcttcatttacatttccaacactatcctaaaagtcctccgtgccctcccccctcttctcccccgccccctttcttggccctggcgttcccctgtacttaggcatataaagtttgcaagaccaatgggcctctctttccactgatggccgactaggccatcttctgctacatatgcagctagagacatgagctccagggggtactggttagtttatattgttgttccacctatagggttgcagatcctttagctccttgggtactttctctagctcctccattgggagccctgtgttcctaggcaaaatgatggacctggatggcatcatcctgagtgaggtaacccaatcacaaaagaactcacatgatatgtactcactgataagtggatattagcctagaaacttagaatacccaagatataagatacaatttgtaaaacacatgaaactcaaggagaacgaagaccaaagtgtggacactttgcctcttcttagaattgggaacaaaacacccatggaaggagttacagagacaatgtttggagttgagacgaaaggatggaccatctagagactgccatacccagggatccatcccataatcagcctccaaatgctgacaccattgcatacgccagcaagattttgctgaaaggaccctgatatagctctcttgtgaggctattcttgggcctagcaaacacagaagtggatgcttacagtcagctattggatggaacacggggcacctgccttttctaacaaactcacaaggcacatagaactccaaaagccatggccaggattgggtttgatttcattgagatactttgctttcttctcatggaggaaaatagaacatgccacctttacctggtgttttctcacattcggctgggcaacttgtgctgttttaaggttttttgttttttgtttgaccttaattaatatttttaaagcccccatggccttcttccggacaggaatgctactatattccaggtgggagagaaatgtacatgtaggggaaagttctttaatcacccatatttgcctcagatagctgaggctatttgcaaaaaatctaagacatgcacactaaactactcagctcataggtttatgcagctggttgattggcgaggccttctgggtccagccattatcaaagcctacgataagtcactgagtgtggggcatcctagattctctgggcatctcattccatagagaaggaagttgtgccatttgtgggtggcctcctaacatatgggtgacaggctctcagaggttgcccttctttggatagcagcccaggcatgctgcatttattttgtctccagcgtcaaagttgatgtttaggctgacagaagcaaggaagtatttgtatacctgacaatagtagggttttttgggggtgggggggtggggggcacctttcttttcaacttcctttcaagaaaaatcctctgaaaagaatttttaagtaaggtttccatagtagaagcagtgggagagaaaagaccgaaaggattggaggctgctgtcttttcccttcccacagacaagtattcaaaaagacaggccagaatctttcatgggagatactaagaaaagttgtaatttggacatcaattgtgattttcggtgttggcttaagaatgcttctcttctaccttctttctccagacatacttcaatgacaatatcctcaccctaatacggaccctggtgacaggaggagccacaccagagctcgaggctctaatagctgaggagaatgcacttcgaggaggctacagcactccgcagacattggccaacagggaccgttgccgagtggcccagttagccctgttagatggtccctttgcagacttaggggtgagtctacagctcaaataactcctgagtccaatgtctgtagcaagtatgatctgaatgacctatgttggatggtgacaagctaggcatctgtgtgtctctcttccactgtaatagactaaagagatggaatttatggagccttagttaccaggacccacactttatacagaggtcttcctgcaaattcacctaccagatctttgctctctggcaactgaggcgctagggcatttgcaccaaggcatcatggcttcgatgctgaaggcctttcctccactgctgccttccttgggtattttcttcacagagatggaaggggcaggtgctaacacaacacagccaaggttgttaagcattttagcagagtcttgatactcagctttgactctacctgagcatggggattcttggccccaaaccctggtaccatagttttgtatctgcatactgttgacacaaaaattatagcactcatcttaaagggaagtaagagatactttattctagagccatttgggaggttaatggctaaggaacacatctttacatactacaaattccttgttttcacatgaagacagtttcatgaagttgcatagtttcacagaaccaaggaagctagaaattgaggcaattttaaaattcatcagtagatacaccagaagcagatacagcaggctgagagatttcctataggccctggatgctgtctggtaacatttataacttttgggctggtggcacttagtggtctgctaattaataaattttgaaatgtttgtattagtcacaagatgttagttctgacagagagcacttctgacagggcaatcggcagctgttgtagagggctagaaccagcccaaaggcaatgagcttctgacgttgcaacgttctaatcttgccagtgtattgaagttctgatcagtcactggactctatagacacagcttcatttgaggatattttgttcatagtaccatccaggttctggtgggatttgaagcatcaagaccatcatgtgtatccagcaccattagccaaagtggcagggtctcaaccagcacggtagatgtcttgatgtctctaattggtcttagggtttctgagtctggacccagccactctttcccaggcttcctttagtggaggagaggagagcctctgtttggattctgtgtactcccttgggtcaggcactttgggaaaagtcccaccttgacttttattccaaattcacctaaagaaggagttttaggagtggaaccgtgagtcttcgggatatttatacttattgcacaaaaaatagtgttccccagaatgtcccattgtggagaatgtcttgttttgtaacacaccaatgtctccttgtgggctaggacctacattaatctggggccattttaaaaggaattccataatcagtggctcttttttattacttgcttacttatacacttgaatcagacttgtgttttcaacaattgtaagatgttagaaccttttcagtctaatatgatgcccatcatcctgattccagctatagcaaagatatacagttagtctctctgttcctatttaattcactccgtcatgccattctgaaataaagtctgcttggagtcatgtgtctgcatgaagcccagaatttttgattcatttccaaacaagaacactgttttcaccttgtgcaccttgtgagtcgagccccagaacttgggatgtggttgtgaactgattagtaccttgaatcccagttatctcgcctgcagactcccacatcctcattcccctagacatctctgaggtctgcaaattgtgcttttcacacagtcctcatctgaatgaatcttctcaccataggacttacaggggtctcttttattcttgcagtggttttcattatcacttgggcagttttgacatcccggtcccatcacagtggacacagccgagttgggggagaaatagaatccttgcttcctttgtagggttcctttcttctctctggcaacacaattgagaccctccagtgtcacacacacacacacacacacacacacacacacacacacacacacccaacacacctcaggtaagggaaacacagaggttttttgagctacagacagacctgtggggacaccagaggaagctcctatggttgtcagatccccaaagtgaaagtacagagggtccaggttgttagccacactgacatcttcagccacagtctcttggcgtagaccctccatctccagagaccaggaaacaagcttctctttcccccagaccttgattcccaggcaaataagaactgatgttcctctcactccctttgttgtctcccaggatggtggttgttatggtgatctgttctgcaaagctctgaaaacatataatatgctttgttttggaatttaccggctgagagatgcccacctcagcacccccagccagtgtacaaaaaggtgagtgtgtcttcccaccctgccatctcacctgaatgcaatggtaccgatgcctttccttgtctcctccaggcaaatgtcattgtgtgcatgtcttcaacacactgcttgcatcaaatctaatactgagctgaggactgaagagaaacatttattcttttaattactaatagtacatgtgaagccattgagggaagaacttgtgctttgtagagtcccttaccatttgtaggtcccttaccattatagaagtcagaatctcaagctctggtcccatgcatttcttccttggttgctgatttgtttcctatagctgatatttcagcttcatatattttaattgactcactttctttcatatatatttaaatttgtgtttttttctgatatgacttaatttaataaactcataacaggaaaaacattaaggatgcatcttagaattactcaaacctatgagtttgtatagtatagtctaagaaagagggccatagaggtatttctcagatctatagattacaattagctgaggggttaaaataaaaatactatgattacagtcatttcaggtgtgtataaggtaaaagcatttgtgtacatttaaaattatataacaatgtttatatatttaatgcttgggaattacagtgcttagccagagctaaaaattgttacagacttgcagggcagtaggtgtgggggaataaagggagtgggggaacgaactcctgcgacatgccagggttctggtgctctgggcgggaagagtgcagcatgctttccatttggcctgggtggatgtctggcaggggatggacaaggggcagtccaaggtctctgggccccatggaggccagagataacaggttctcagtcttgggcatctcagatgcagctggacactgtggaagagctgagaacaaagtgggggcccttgggggtggttaggtcatccccagggccgaagggaggagagggcagggagagaggggcaagagtccctggtctggtccatggctggaatgcaagaaggccttctggcaggaggtttcctctttagaggaaagcctatcccatcttttaagcacagcggaccttgatgagcagagacagtctatggttttagagttttattgtagaaaggcagggagaaaaagagaaggtagaaagaaagagagaggtgggccatggccacctggagagagggggaagggagaaagagaaggagggctagagatgagagtagaaaggtgagagcttaaggagagagaagggccaagcagccccttttatattgggctgggctaccttgctgttgccaggtaactgtggggaggagcatacctggctatagtcagataactgtgggggtggagtctagccagaatgcctggagcttggggctttatctacgtgacttatagtcacagaattatggagttgggggctctgtggtgtcaggcaccggtcactggtcactgggaacatggctcactgttccattccttgtagagctttttactgagactctattggagcaagccaaacaggctgcctttcacggtcccacacagactaatgtttttctgtaccttggtaagtaggagattcacctacagagtttccaaagaccaaattacagagccccaccctggggcttgtgattcagtagatcagggagtcaggttactaaaatttttttcccttttgtttttagtttgctcatttgttccttcctttcttccttctttgcagtgctagggaatgaacctatggcctctcgagtgcaaggcaaatgctctaccactgagttatatacctgggaacaacacccagcatttttctgaggttgctgggagtctctgagaccacactttgaggtccattgctgcagaggcaatgagctgatgatcactgtagttgtgggggtgtcagccagagaaagcctgatctaatcgtcagagggttggtcaagctctcacacctagggagctatttggttaaagaggtactaggtatgacaaaaagagaccctgcggtgtgtatctgtgactgtcaagacgttctagaatggaagttacagtgcaattgtgcgactgtcgtgaacttgacccttgtacgtttggcccatatgaatgatggtgtggcttttccattaccagctctaactttgcatctttgcctgcccttctagctgccttgttgagttaaacatgaagatttcctttagtttggaagcaaatttgaggcgactggaacaagtagatcattcagttcctcagatagatcgaagcagtcaggcaattagttcttttaggttacaggagagtcccgtggtgtgcctgcttgactcagcctgcaatacctttgctttctctgcctaggtacgtcatcaccaatcctccctacgagtttgagctcgtaccaacagacctgatcttctgcctgatgcagtttgaccacaacgctggccaatcccgggccagtctgtctcattcctcccactcctcacagtcgtccagtaagaagagctcctccgtccactccatcccgtccacagcaaatcggccgaaccggcccaagtccagggagtcccgcgacaaacagaagtacgttcaggaagagcggctttgatatgtgtagccaccggcacccgtgtgtgaaactgtatctgctactcatttccccagttggtattccaacagagtaactttcctgctccctatagtcccctctttttttttcttttcttttcttttttttttttacacattttgcatatgtatgatagtgtgcatgtggttgtcatttttatttcaccaccataaaacccttgagcgcaacagcaaataagcagacggaccaaaagttatttatgcttccagggggaaagtaacgtaaaggcatcctccagacataaatagctcactgcagggatgagttcacaggttagaagggagcacctgagagttaggcaacggaggtttgcctgatttatcaggatcatcaggatgctttgggttttgcgttttcattttttgtttgttttctctctctctgtttttatacacaaacaataagttagcacacagtcgtttgaaacaagcaaccaaaaagcaatgaaaacgcattgatcgtttccactctgggctgaggtatcgcaaaacatttgaaaagctttccaagtgtgcgcaaaagatgatcaagtatctgcttgttgtgagagagcgtcagagactttttttttttaacgtattcaccaaagcctttttgtctcggagctagcgtctttcaggtgtttgagtgaatgtttctaactttaatgcagagagaaaaacaggtttccactcctggatgtatcaaatcttagtcatttcatttacctgaaaaaaggcttgatcacatattaaactgttattctgtctccttatgctgccatagggatagctagtttttttctttcacttttgacatttgggatgaaaagccatatgtatcataaatatcagatgtaagtcattaagaactgccttcctgggacttttacatcctttaaaaggtgaatcacttaccttatgtacagaataaataacactcagaaaagagcaagtatttttccatgcattctcaagggacctttttactcccctttgtttgactaacgagggccccgatgccaagtacaattcaggctggggcaatggtagagcaggaaggagacacccagtgatagataatggtttcttgtaggagctgacgtgctcaataaatcagaatgtaggaggatagagccacagttgattcaagaaagacaaaagctagcgaccacatttaaattgctggcacagctgcatgatgctctgtcccaaagcagatggctggcaggaaaggtctaacataggtaaccctcttaaatgtacagccaattcctataggtagatgagagacaggggagagagcttctcccttcatttcaagattggaaggaggcggctgcaacagtaagccaaacacattgcagtagttaatttctttcttttctttcctttttttttttctttaaaaaaaaaaaaaacaaacctgttattcatcaagggagggaagatagatagataccttttccccaatatgcaactatcagatgttttatgcatgcaaattatgttttaagaacatagttctgaagaattggccaactttaccataaccaaattctggtatgggtagactagccttgggctcatgtgaacgtatttgggatatttatttagaaatccactgatagaacagggggtagaaaggaggggggaaatctgtcatatctttagcatctctttttaaaaggtgtttttatggtgaatgttttgggtttagatttttgatcccctgtcccctccagcatgatggttttggagatttgcttgctgtgtgactgacaagcacttttactgacaaaaaatggtgaggctctgtcagaacctccacctcaccccacaccaaagacaggggcagtgcagtattccaaccagcaatgggtgggcagtcaatgtatacatgtaaattcaaaagtcctgtgagtggaagtattttttttcaaattatttttgtccttatgtatttgatttatatatgacatctagttatctctttatatataattatatatataaaccatatatatacatatatatataaatatatatatttatatatatgtatacatgtcccctagttttggatcatgagagatcttcatgcattctttgcaaaggaggttatgaggttacgccttcagaacattgataactataagaatgtgccagttaaagtgctcaacaggaaatgacagtttcaaagcattgtaaaactcacatagcttacttctctctctaaagtgcaacaaggatgactagaatgggccaaggtatgacaattaatggttctgcatgacctagccactgctgggggttttcttctataacgttgtccttgtgaaacttttgtggaattaaaaaaaaaaaggagttacaaattttattctgttattgtttatttttatttaaattgttctgtttgtggttctctttcatttgttttgcttctccaccctccccctttctcctcctcttcctttctcccttccttcttctttttcttcctccactttctcaattgctcagcgcaatgaggctgtgctgctgctatggctagatcccttagagtttgttttggtgttcttgggggtcgggtaattggggggtaacttctctccatctggcttgccttcaaatctgcacgtggcctccctgcccacctcggtaccttgccccaagtccaaaagcattttcccattgagaaacccagcttcttccactggccccatcaccactgcccgaacccagccccaactggtctgttcacatctctgtgttgatcttggcaagacccaccaaatcgaacaatgatgccggttgatagatgtttttgtaagacattcacagctattccatttggcaaatgtgcttctctgttaatagttgaccctcctttggtctgtaggaggagggttattaatggcaaatgcattggtctgttttcctgtttgatcagaaggaaccaaagtcaaagctgttgagccccgtgaatccacttgagagcacatgccaggttctgaaggagctgatgactcagtctggacagaactcacacgtgtctcctaccacctgccattcagacatttgttaaatctcaaccacaaacggggcagacagatgccaatccaaagtgtctttttaatgcaattgattagtggctccagtagatgagactgtaactgactggaatgggaacagactgtgacatgagatgaaatctgggagttttctctggactttgggcacataatccccactgggtaattacagatcattgagaattgatcatgagtgactactgatatatctggtggcaacgggatcatgggggatcatggtgacctctcttttattagctgaaacttctatattatactcttcttaatagagtgaagacattcctccaccatttaccatttgactcgaaattccctctttcaggagaagagaggctcctttaggaaggaggcgcgtgggttcttcatgtattgtctctgccctacttcttccttgcccaaactagaaacagacaaggaatgttagaaagtgagagaacactgtgaaaagaaaaatgcacatattttataagaatcacagcttgaagctcggtgatatccccagttctggaagagaagcagtttgtgagccattcagtttgctttggtcaggctttggaaagggccaaagtgaagtgagtttggagagtatgaggaaaagctttgcgccaactgtctgataactgtggaattgttaatatccctagaagctgctattggagtccttctcaactccagttgaaagagacccttgaactttccagtctcccctatattttggagatgtttccaattccattatgaaattaaggcttatggcacaggatattaaagtaggcacacacaacacgtatttgaaatcattttcccatttcaaactctcttataatttatctgcatccccttggtttattcttggaaaagtagccattaatgcctgaggtgttgacacagctgatttgctggtgtcagactcttggagccagattctgtttctaagccagggagacaagccctgtgagcttagggactagagagactgactatgcctgatggcaacattattgagatcctaggtgaccagaggaacctttgactgactatctttcagcatggggaatgccttaaaggtgtctatatcccaatagagacaattatatcaaccttccaggttcctatagcaacagactccttgaagaacaagaaagtacagaaacttctgggagcaaaagataagacagggtacaaatcaatttctccaccagcttccatcagccaatccctgctttgacacaatatgataagggagtagctgtaggcatctgtcattgagctggataaatatctcccataaggagactgcacatggaagtgagcagaagaaactccattacctaagaggcaagagtatcctcagggtttggctggatgcaaggatggacagtcagagtggtccattacagagaaatgagataaaaggaaacttgtcagagtctggtagaaactgtgcttatgtttcagatggctatgttctcctgaggtagaagaggaggaggctggatgcatagttttgcctgggaggcatctggttttgtaagtgtagggagtttaccacactgcctatcagaaatgtaatccaggaaaccacatagagttgcccttacagattggagctctttgtagctattgctgtcttctcctctgtatccaaatgggatctttcccttccatgcctttgctctcaaagcctcagcttgtggtgctatggaaagccagttattccacgtgcctttactgtgttatcagctccccacttcagcagtcttttctggggagtagttatatgaaaaggctgatcacaacactgaccaaccacagtgccaacaaaagtcctgtgttcacagtgcgatggtttttccctcctctttgggaactttaggtaattcagcccttctttaccataataactctctaaactcttgttctaaaccaatcatttccttatactggcaattgaagacataggtggttttccacggggcaggacatccttcacatgaaaactgccatcagaaacaaggacccactacctcacaaccctgaactccccagtattacaccatactataattattatagtaactattcggccttactttaattcaccttccaggcaaagactacccacaagatcctcctgagtcacctctatggcaacaatctacattcttcaggctagcccccaacttagacacctcaggtctctgcttctggctcctccattgaagaagttcatttgcaaatactacattcagaaggtgtcacccactcctacatcatacttataccaatactaaccttaaagctaatgcctaaggcagccatcactggtactctacccagcaagttacatctgtaaacacatttaactctcatgatcaaaccagatggagggcttatgagaatcttcacaggacagatatggaatatgaagaacaccaaagtctatgcactaatcttagccattgtaatacagtgcctgaatcatgaataacagtaacaaacttagcaaatattatttgctgaccatgtagctgaatgtgtagtaagtcattgatacctgttccattgatatagctaacaagatttggaagagtattttctcaaccctattctatagagaatgattaacaataagatactttgcataaccttttcagagcagatagtatgtgagagagatccaggtatacttgatactagtccacaagctagtgccatttcattgcccccccaacacacatagtgtgtccagagtgtacttagtggcttaattggcccactgtgtgacactcacaatagtgtagctgtcatttttacctccagttattttctcaattttattttgttaccagcctgcttatcacatataggaacatgtcatttccttactgtctctaagtgccttatgacaaaagctccttagaggtcacacagtgtcctcagaatgaggtcatcatgtatatattaaccacaagaagtttatgaacaaacaggggtattttattttgttttgtttgcgttttgattttgagtctggtaccaggaaggtccccagagatcacagaacctcttgtctcaggcatgaaataaggccacagagaacaaagataagccaagcattagagtggagttgccttaactacttcagtacttattagaattcctagtttgagtcctccttctagtgttcacttttgtacttctccattggcacagctttgtccttaaatggcaagattctgtgtgccatattgtccccatattacctgaaggacattacacagaagcctagtgactgatgaccattaaaatacaacccctctgatgctgtttgggagacctttgtcccccaaaattttagacactgtccagagcatctcactagttcgatttcctcaacatcttacttgaccatgcctccacagcatagacattgagacactggaattaaacagtgtcctgtcaggaacaatgagaacctcaactcctgatgagaaggtgtttgccttcaaccctttccttgcttgaagcttcattctcaaaccacatgggctagactgactaggttttctcttttggacaagaaatgtaaagagaaaggagcttaaatgaggccaataatgttgtctttcctacaggcagttggaggaaattgatactctttccatggtgaaaggtcaaaataccccctttgaattgaactgtaaatactaaattctcaacaagtattctcagcagcagttgtaaaaatttcagcaaattgcagctgtttggtttttcacccaaaacacatcccccccctttccatcagtgagacttacttttcctaccttacaacccagcactaaatcccttcagcaaaatcgttccgggtaactattcggccaagagccaagggcagcttgggcaaacagcataaacaccaggctcctctctgagagccatctctgcacataagctgtttgaggaagtcatagttggaaattgtttcagagacctggcaatgcttttaaaacatgataactatcacactttactcttctctgaaaggttagtttaatcgtagatcacaaaaaaattggtttccacaaatgcataatggttcatctatgtcacacttgaactaaatggttttttaaatggagctgaaattattttgatgtgtacacagtcccagatttctatacaaccttttttaaccagcccatcaggagtcttgcctctaaagcctcattaataattcagatgtgctgatgactttaaaagatctatggaattgaagctcagggaaagaaaaaaaaaaaaaggaaaacctctgcttgacaaaaagataaatgaatgtagaaagaagctgtaggaggctggcgagctgtagatcatcccagaacagattgtaactttatcatcctgtcagggggaataatttaaagcgcttaatcagttagcttcactgtgaggatacagtgttatgaattcctctcagccaatctgttcaaatcaaagtgaacttcattgtcataggtgagatagccagggcaggaggaatcacagagaggagcatagaagaggcaggaagtgtcctgagggttaacctgggctcttgaaccttcctcaggctttttccctggccccagaggcagccatattgacgagccagggcatgaaatggtggaaaaggcagagtgatcaagaagtcatcacagatgcttaacgtttatgagccaacacatacacacacacacacacacacacacacacacacacacacacacacacacacacacacacacagtcatatgcaaaggcacacacacagcaagctgggcaatcattttaacaggtaggtctacaaccagacacaaggccaatgcaaatggttttataagcaataaaacaaacaacaaacaaacaaacaaacaaaacaaacataacaaacagaagcaagagggatcatcctctcttgggcagtgaatatgtttgaaagttgctttccttccctaagccactgtaatgaagcctacgatgccccacgctagatgttctattgcccagttgcttcacatggcttatttttcagaaaatgtcagttctggaaaggggcatacattggacttagacccagctaagagactgatcctctgtatagagcccgaaaggccctgactcagcagtctcactcatccacttcttagctcttagtggagaaatgacagtggcaagccaccatgagctctctgttcatagcttgggttattagagtcagctgagatactgccacctgcaactccttccatgacctcatacccacagagttcttgtgctttaaataaaagccacttagaaattctcttttaaaatagttttctattctgattttccacgcttattggccagcaaatcctgtggggttcctttaagggatgcagacaagacagaagtggtccagctaacaactgcctttgagtctgcttatcataacaaaatcaaaacaaggctgggaaagaggttaaactgaaaaaaccttctgaactacgtgcgctgcagtagggatgctgttcatctactccaccatagtctctgaggtcgggctcctcctagtgtctcccagtcctgatgatagcacattcatttctttcttcacttgctacagggaggagaggcatggttcaggtttcgggggcttctgtacactgcatttcttagcaattactcactgccggcttctattgattacctttatgcattttcaatgaactttccaaaagctcaacctaggactaattaagcttctcatttctccttcttgttctctatccattttgccctttagcagaaaagaaatggtttacagatgagccggataatgcctatcccagaaacattcaaatcaagcccatgagtacccacatggctaaccagatcaaccaatataaatccacaagcagcctgatccctccaatcagagaagttgaagatgaatgttgactcccaggagaccagaactatttttttaaagcctgacaaacttcataaatggtgacgtgacttttcttcctcttacatgctgaatcactggtggaaattctagaataagcaagaattgcaagaaaataaagttagacagatctttctctttgccttgaatactgcttccatgtattttggaaaagaaaatgatttcatttataaatgaacatactaaaatagtcatgtatagcttctagtgttttaaattatttttatttattagaaagaaaatatattttttctttttttttcattgccagatatcttcccatatatcacagcaatgcaaaatcaaaatgagttagtggccagattccttgatgcacatttctcttctttctctctttttctttgaggagaatgatggtcaccaccccaatttgtaaagaagggaaatggattactaaaacaaatttaagatggccaacattgtatgcacatagttcagtaaatcaaaaaaaaaaaaaagtcaaaagagcggaggtgaatatttccccctctcctggacgggtgtatgttttgatctgcattgacaccagctcttaacaaatcaaacttcattatcttcccagttgaaagtcattatctttgtagtttcagttttcctccagtgtttcttatcctttgtttatatatttagaagaaagagcttcttgtaacatttctgcagttgccagatcaggtttaagcaaccagctcaggatatggggaagggttataggcacacctagaatgtgaaggtcgtgagccagaggcacccaagagcagactctgttgttctcatggtgaggcctcctccgccattctttatgctccctgtttcatacttctaaggcacccatgcaagtcatgtggactgtgggagagtctgctatgttcttttccctgctcagagcttttagcctgaaagttggtgaacatcaacgaatactttacctaacaataggatctaagaagtatgcatgcttaccacaaatttttggttcggtagtctgtcaaggagatgacttttgctcagattttcatttgttggctttccttggttgaattgctgggataaaacattcaaactcgctaaaatacttacaaaaaaagaaaaccaaccaaccaactaaccaaccaaccaaccaaccaaccaaccaaaaaccagtaaacaaccaaaaggaaagtaagtcatgctcttaacatagactgttagaaaaaggccttggaaaattaccagcaatgaaataaaatgtatcagccacttcaacgtgtggtcaaaagatttttctagccatcagatgcaatcgtgatgtctgagctctgctgttgcatgcatgcccagtgtacagtcacctcaacaactgtttcattccaacgactcagaaagtcttttcaacttcacagtgatcgacctttgatatgatcatcagggtctctggagaatcctgggtgtgactgtgatttttatttccttagaaatgtaaaatgtgaacacttttccaaaccaacaaaaattgcccctacagacccatgacatctcttccatgaactctttaggccatgattctgtggtacctagttatgatagtacaaatcagatcagagaaaagcaatgtgatcactatggaaacatgtccactaaggactccaattaccaatgtaggcaaaatgagcttccacctctgtccactccctgcagagccaatatagctgtgcttccaccttgtaggcgttgtcctgcagtgacttgtcagactgtggttactctgttgtcacactttgtagaattagttctataaaagtattgtgaatataatgtgtgtccaattggattgttaacacaaaaatatttataaccaatcactagtctactcaggctaaaatgatgtcagcagttttatattcgggcttataaacatttcttggtttccaacagaactcagatgtgttggtggggagaatccactgccagaatcttgacagcattcctgaaagctaagacttcctttaacatcatgattttgcatttggggttacctaagtacattcatgtcaatccacgctcttctttccttcctgaaccatagtaggctcttctttacactcattccaattagtcttacctctgaatttgtcttagttccttaatctcccatggtgaccaatgttttttacctaaataattttccatcagaaaaataatggtctcaacactaccccatggaaggcaggactcagaagcataatccccatttcccactctagctagagatttaaatctaaacttgtttctcaaccacaatggctctaatagtttcctacactaagtgactccctccactcaccaatcagcttccaaagccctagatagtagaaatccatttccttctatgatagagtaataaatgaggaagaggtcaagcatgattctcagattgtccagaaaatgaccatgtggtggccccatctggcaaaagcttatggcaactcagttgaaacagaaataacatttgttaaaaaagaactgaagggctcaagacaacatgcaaagttcccagtttgcatctgttggttgagttctgagttctctgtaggattaaatagtctttccatccacattaggccaatggtggtcctctttggaatattccacattagaagggtctgatctttagtccctgattagggtttcagaaaagctatcttggcaaactaatgatgcttggatgctttgggaatcagaccatttgtaaaatagaaactacctgtgtacatcattgtataatgatgatgtacctgtaaacattgtacctgtgtacatcattgccatcaccatctttctcatgaatgcagtttgtcttcgtttaagcaactgtattttgaaattactctcccctgctatagcaaatagaagacattcacttaaggtgttttatatttataaattgattacgtctaagtcacttggaagaacagccttccttctacaagttgcactttgtttttgttgttatttgtttgtttgtttttaagtgttggaagactttagtaaaggaattagaatggttttgggttgagttggaagtgtagactgggaaaatgtatgaaattagagatattttgaatggagaacagaaagtttccaactgtgcctgatttagaagttcaagagcactcatataattttagctattaactataaaaatgttctttaaattcttcaagtttcattgacttaaacatgaggttggttcgtggagatggcgaaggtctttttcagaccaactaaagcagtggttgccttacctcagccaagccctgggagattattttttttccagagctgtaattatggctctctggccatattatccatatagcatttctgagctaaacacagcatccactctctgctctggacaaagaacagtcaggttcatttctatattctccagtttgaaagctcttagagtggagatgcaaaggtttaccttcagcctcacctccaccactgatgagctgggtttagtcattctggtttctttttacagccttccttcccaccttccctgtgtcttggtgcagtggagattggatagtctcttcatttttagcccacatctccaatagtatgtagaaagagtttggacaaccctactctgctactgctattcccattcatgtcccctctctacactcacccttacttctcatttcattccatttgtctggttgtgcccacgttagcacaatgtctttgctgcttacattcaaaagtgccattatgagttgtcaatatcatcgtccaggaggacctcgtggaaagaatgatagaaagaggtagaaaagtacaacaaaaatcagtatcagacaagtgactcagagtcatcttgattaccaaaagatcacacaaattcactgaacattaaattctagcccaagatctgcccatttttattttaaccatattttctgcttttggaatggtggtaaagtcatagatacagtagccctcactacttatctctttagccatcattttcaaaaacttagacaaactgaagaatcactttcaactttcccactagattctctttctgcctctgctgtttcccccatgttttaaacaagtatgtttctgcaatagaacaatgatttctcatttaaatctcataacctcttgataaaacaaggagtccctttggactcatttaggttatttaaactaagtttatttttaagtggtcatagcccatacctattaataattccaagattaccactaaaataaggctatgcagaggacattttaaatttcagttttgaatacctatggtaagagtgattttaaaatatttaaaagattaagaaagggacccatgtagccctacacttgttagaatcccccctgcattccagtctcacatggcttcatggagaaatgattctcttttagactttttgttctagatcactctttttaactgtgcttttgagcatgaaaatgcacaactcagagtatatatcaaaaggctagaaggaagaacaaaaagagatagatgcaacactttaagaagccctggaaagaggtggtacttacgtagaaaagaagaggttcccttgaatcatgaatgggaaaaataataggctgggctgtggagacttttcaataggaaatacttagtttttgactggaggcacaaggatcgtgagttttgttttgttttgttttgttttgttttgttttgtttttccaatgaaagaggccttcaggagctataatgcactagtaccaagatgattttgctatatggaacaacttaccttcaaaaataagtttgtgtccatgtacttactgaaaacaatgtatggcaagagttcatggaaggaactaggaagtggatggttgaagagccacattgaaatcagagcattgatttagaaagtcagagagaaccatggaaagggccgcacaaggagcgatgggtagtggtgactgtaccctttggggttgaagcctttgagacattctattctttctggaaagcatcacagaaacataggctctcaagttgaaccatctctcagcaacttgagatcctgtgattgcactcaataacagctcaccatgaagaacacctaccttcttcctacatttccaccttgtcatgcagtactcaattattaaaacacccatgggtccaccacacagattaaaggaaaggaaaagattttcagattattttacaaaagagtcctgctggttatactattttacagacactaatataataacagacaccagggagaccaccaaaaaaaatcatagaataatcaagaatttagttggaggaatgagtatgacacattcttgcttgcagtaagcttgaaatccaacttaaaggagcaccctaaagagccagtagagaaaaaataagcatggctagaacactgccctccaatagagcaggagataagaaacaagcagtttgaagcagttaatcaagcgttgtagactagacggtgtttcagagttaagtatgctgaggagcaacatcccagctcattcaggaacatggatggatcaatgatttcatgagttgatcgagtagtccctgtgcacctgttgctggacagcttgtgtcccttcttggcaacaggagacatgttatgtagaacatgcatccaataaagacttttaattggatgggctacatagcaagtaagtaccatgacagctgtggaagtttgacttggattctaaggatgggcagtttgaaagagtctataaaaagtaatggtttgctgcagaccccaaggacagagcagtgcagagggacagaaagaagaggagagatgagaatgtgagacaagaatttagacagctgagaaaggggctgctttcatccctataaaaaggaggggagagatccatttcaatcatgaaggtattctggactgaagatgcaaacagctgagaagatgttttgggaggtccagatcatgaggaagccccctttagcccccccgcccctgtgattcaggtaattataaagggagaagtctggatgaggtttttcaatgaagaaaacataggcttagatgacaggtcagtagaactgtctggaggctatagccaagttttcaggggctcaatggagcaaaccaagctgatatgattaggacagaatatctttttagtattgggagagtgggaaacagaaaggagggcttaaaatagagaaaatgaaccagtaactgagggttgagatacaggggatctgaaatagtgaagtaatgaggcagactgtaaggaccaatttctccttttgtctttatctcatgtggttgccatgaagactggaatgagtgggaaagtagcaggtcattctcggtcagtttttacaccatggaaatggggtacacggggtacccaggtcatcagcatgccctctaaagtacccacagaaaggtcttgagaggtggtctctcctttcatcagttcatatcacccccgttgtacctcatccctcatgcatagcacacccagaaccttctagttgcaacagtcttcatacacaaaatgcaaaggtcgccttgttctggtggcttttctggaccggggtaaacaggaatgctttttggccaagtgaaaactgagctcctttctaggtagaatattacattgaaaagagatttcccctggtctgtttatcccatgagaaacttctgtgtttcttcttgtcctccaaagctgaccccgaagctccccagggcctgtcttaggaaacagcacctgtcctgctgtttagagtcttcgatggaaatgtacacacacaacacatgtgcctgtcaaagcatccccgaacttcctgccctagggatccaggaggtagccatccaggaggaggttgtcatagggaaggacaggaggaggtagtcatccaggaggaggtagtcatggggggaaggagcccctataacgagacaagtcaagccccaggtctccacgaaaccagagccgttccccttctccttccgctgtgtacacatttgaccagaactgcaacatttcaaacataaacccagatctgcctggaaatcctaattaaaaacgttccattcccaggtggtacaatcacatcctgcctaaagtgtctggctcacggcccaccacacagatgccgaaaagagacttttccccacttaacaccaaaaccttcatttgggatttctttaggggacaaagggaaaaaaaaaaccaattcagaggtacccatatgcagaggtcagcctacaacacattcattaagggaaaagagcgtggtttgtttctttgtctttcacactttgattgctggcatggtgactgtggctatgatgaattatgtaaccagacaggaactggagaagagaataaatgctggtgctctgaaatgacctacccaactctgtcatctgtaacaaccagtgataactctcttgtcttgtaaaaagggtttgtacataacttgtacatggtttcattttgtatttttcgcagattaaaaatttatgtatttgtgttctaaaacaaggagtgtttcttgtgtctttgtaactgtcccatagggtgtggggagggttacctaaggtcccatttcacccccttctcctttgtgaaggtgaaattgtggaccagaagcagccatgaagttgcttcttcagttgcaactgtgggacagggtacttcccaacataggcatgagcagtgttggggaggaatggacgctggtgtcattaaaaagttcagagtcatacagggccacactggttgagagggtcacatgctgctacaggcgactccagaatatagtgctctaaagacactgcctacattccatagaaccttgagaagtcaacactggatcacttctgccacctgctcccatgctagctacccttccttgctattcatacaaatgagcaaagtctccctgcttcttcctcatcaaaacacaggggttgaagcttgcttaaggggtgggccttcttgttcttcacacccatagatgaaatgcccaagtcaataatatccagtaacaatgatactatttgagtctagatcttcagaatcttgtggatttgaagcccttacaggacaccagtctccttagtctaagactgacctggcttctgagaaaagaagatgctggtgagagggttccatgtatgtactatatatagactgtcaaaaattaatatcattagagattgtacccttcttcattagccaacattaactaacttcattagttagtgtttacattcctttattgggacttgttgacaaaacagtatgtaataacatgactctgggtctctagttgaagtaataaattattggttcacatattaaaaattgatctgtgggagagagtacagcatgcccttacagagacataaaaggtttgcttagctattgaagaacaatctgattgataccttgaaagccaaatctctgggtacgtatgcttattagtctttgtcaacgcaacagagactagaaccatctggagtgaggaaacctcaattgagaactgcctacaacaacttggcctgtgggcatttctgtgaaacattttcttgattaatgattgatgtgggagggtctagcccactgcaggcaatatcgcccttgggcaggtcatcctgaattgtatatgaaagcaagctgaacaagccacaaggaccactccagtaagcaactttcctccatgcgctagtatctgcctctgtgttcctcccttggcttgcctcagtgatggactaaacccataagttaaaaaaaataaaaagcctcattcttaccaaatgtactttttctcgatgttttatcaaaacaacagaatagaaagcagaggcagtactcaaacaaaaccagccccaagcagaccttattgccaggagtgagaaactgcagacttgcttaccttctcctgccaactcctcacagatctttgagctccagagtctcaacttgtcttctcaatatttgctaacaaatctgaatgttgttggggaaatgtaattgcagagcatatggtctccattagtcaggcaaactctactgccaagttcagctccaaggaaggagtctgcataaaggatgaaatattagggaacgatccatagtgacagagaagccaaatgaaagagatgaggcactgagttgcaaaacagtaggcttggacaaaaggacacaatgactgtggaacatggttttccatttggtaagaaaacaaaatatctgtgaatttctactgagatctctccgtagcaaaaatcaaaggaggccattcaccaagatcaatattaactgtttctcaatgtcagacgagatagattctgcctgggagaaaatcgtagggcaaacagaatacacagcttgctaaaggaataaagcaaggatgagatcaaaatgtaaacatcgggcatagtgctattttcaattgctgaggctcagccttccaaaagagagacaggttctcatgcttacagatctgtcccattcttaaaatgtagggtaaaagtcagaaactcaagggatctaagatcaagaaaaattattcagcacccttgccacaaaaatggttttgcaatatgccttttaaaataagaaaatatgttaataagttggttatacttccagattgatacacatagatttaatttatcattttactcaacatattgagtctaatagctaatcttggttgtcaacttgatagacctgggaaaggggaacctcaagtggaattgtctccaacattttggctagtgggcatgttttgggggggcact

SEQ ID NO: 164 - DNA, 3516 bp, Mus musculus
atggatgcgctcatcataccggtgaccatggaggtgccgtgcgacagccggggccaacgcatgtggtgggctttcttggcctcctccatggtgactttcttcgggggcctcttcatcatcttgctctggcggacgctcaagtacctgtggaccgtttgctgccactgcgggggcaagacgaaggaggcccagaagataaacaatggctccagccaggcagatggtactctcaagccagtggacgaaaaagaggaggtggtggcagccgaggtcggctggatgacatctgtgaaggactgggcaggggtgatgatatccgcccagacactgactggcagagtcctggttgtgttagtctttgctctcagcattggtgccctcgtaatatacttcatagactcgtcaaacccaatagaatcctgccagaatttctacaaagatttcacattacagatcgacatggctttcaacgtgttcttcctcctctactttggcttgcggtttattgcagccaacgataagctgtggttctggctggaagtgaattcagtagtagatttcttcacagtccctcctgtgtttgtgtctgtgtacttaaacagaagttggcttggcttgagatttttaagagctctcagactgatacagttttcagagattttgcagtttctgaatatccttaaaacaagtaactccatcaagctggtgaatctgctctccatatttatcagcacgtggctgactgcagctggattcatccacttggtggagaattcaggggacccatgggaaaatttccaaaacaaccaggcacttacgtactgggaatgtgtctacttactcatggtcacaatgtctacagtgggttatggggacgtttatgcaaaaaccacacttggacgcctcttcatggtcttcttcatcctcgggggactggccatgtttgccagctacgtccctgaaatcatagagttaataggaaaccgcaagaaatacgggggctcctatagcgcggttagtggaagaaagcacattgtagtctgtggacacattactctggagagtgtctctaacttcctgaaggactttctgcacaaggaccgggatgatgtcaacgtggagattgtctttcttcacaacatctcccctaaccttgagcttgaggctctgttcaaacggcatttcactcaggtggagttttatcagggctctgtcctcaatccacatgatcttgccagagtcaagatagagtcagcagatgcatgcctgatccttgccaataagtattgcgctgacccggatgcagaagatgcctccaacatcatgagagtgatctccatcaaaaactaccacccaaagatcaggatcatcactcagatgctgcagtatcacaacaaggcccatctgctcaacatccccagctggaactggaaagagggtgatgacgcaatatgccttgcagagctcaagttgggtttcatagcccagagctgtctggctcaaggcctctccacaatgcttgccaatctcttctctatgaggtcattcataaagattgaggaagacacatggcagaaatactacttggaaggagtctccaatgaaatgtacacagaatatctctccagtgccttcgtgggtctgtccttccctactgtttgtgagctgtgttttgtgaagcttaagctcctgatgatagccattgagtacaagtctgccaacagagagagccgaatattaattaaccctgggaaccaccttaagatccaagaaggtactttaggatttttcatcgcaagtgatgccaaagaagttaaaagggcatttttttactgcaaggcctgtcatgatgacgtcacagatcccaaaagaattaaaaaatgtggctgcaggcggcccaagatgtccatctacaagagaatgagacgagcatgttgttttgattgcggacgttctgagcgtgactgctcgtgcatgtcaggccgtgtgcgtggtaacgtggacacccttgagagaaccttcccgctttcttctgtctctgttaatgattgctccaccagtttccgtgcctttgaagatgagcagccgccaaccctgtcaccaaaaaaaaaacaacgtaatgggggcatgaggaactcgcccaacacctccccgaagctgatgaggcatgaccccttgttaattcctggcaatgatcagattgacaacatggactccaatgtgaaaaagtacgactccactggaatgtttcactggtgtgcacccaaggagattgagaaagtcatcttgactcgaagtgaagctgccatgactgtcctgagtggccatgtcgtagtctgcatctttggggatgtcagctcagccctgattggcctccggaacctggtgatgccacttcgtgctagcaactttcactatcatgagctcaaacacattgtgtttgtgggctccattgagtacctcaagagggagtgggaaacactgcacaacttcccgaaagtgtccatattgcctggtacaccattaagtcgggctgatttaagggctgtcaacatcaacctctgtgacatgtgcgttatcctgtcagccaatcagaataatattgatgatacttcgcttcaggacaaggaatgcatcttggcgtcactcaacatcaaatctatgcagtttgatgacagcatcggggtcttgcaggctaattcccaaggattcacacctcctggaatggacagatcatcacccgacaacagcccagtgcacgggatgttacgccagccgtccatcacaactggggtcaacattcccatcatcacggaactcgtgaatgataccaatgttcagtttttggaccaagacgatgacgatgaccctgacacagagctgtacctcacacagccctttgcttgtgggacagcatttgccgtcagcgtcctggactcactcatgagcgcgacatacttcaatgacaatatcctcaccctaatacggaccctggtgacaggaggagccacaccagagctcgaggctctaatagctgaggagaatgcacttcgaggaggctacagcactccgcagacattggccaacagggaccgttgccgagtggcccagttagccctgttagatggtccctttgcagacttaggggatggtggttgttatggtgatctgttctgcaaagctctgaaaacatataatatgctttgttttggaatttaccggctgagagatgcccacctcagcacccccagccagtgtacaaaaaggtacgtcatcaccaatcctccctacgagtttgagctcgtaccaacagacctgatcttctgcctgatgcagtttgaccacaacgctggccaatcccgggccagtctgtctcattcctcccactcctcacagtcgtccagtaagaagagctcctccgtccactccatcccgtccacagcaaatcggccgaaccggcccaagtccagggagtcccgcgacaaacagaacagaaaagaaatggtttacagatga

SEQ ID NO: 165 - protein, 1165 aa, Mus musculus
MDALIIPVTMEVPCDSRGQRMWWAFLASSMVTFFGGLFIILLWRTLKYLWTVCCHCGGKTKEAQKINNGSSQADGTLKPVDEKEEVVAAEVGWMTSVKDWAGVMISAQTLTGRVLVVLVFALSIGALVIYFIDSSNPIESCQNFYKDFTLQIDMAFNVFFLLYFGLRFIAANDKLWFWLEVNSVVDFFTVPPVFVSVYLNRSWLGLRFLRALRLIQFSEILQFLNILKTSNSIKLVNLLSIFISTWLTAAGFIHLVENSGDPWENFQNNQALTYWECVYLLMVTMSTVGYGDVYAKTTLGRLFMVFFILGGLAMFASYVPEIIELIGNRKKYGGSYSAVSGRKHIVVCGHITLESVSNFLKDFLHKDRDDVNVEIVFLHNISPNLELEALFKRHFTQVEFYQGSVLNPHDLARVKIESADACLILANKYCADPDAEDNIMRVISIKNYHPKIRIITQMLQYHNKAHLLNIPSWNWKEGDDAICLAELKLGFIAQSCLAQGLSTMLANLFSMRSFIKIEEDTWQKYYLEGVSNEMYTEYLSSAFVGLSFPTVCELCFVKLKLLMIAIEYKSANRESRILINPGNHLKIQEGTLGFFIASDAKEVKRAFFYCKACHDDVTDPKRIKKCGCRRPKMSIYKRMRRACCFDCGRSDCSCMSGRVRGNVDTLERTFPLSSVSVNDCSTSFRAFEDEQPPTLSPKKKQRNGGMRNSPNTSPKLMRHDPLLIPGNDQIDNMDSNVKKYDSTGMFHWCAPKEIEKVILTRSEAAMTVLSGHVVVCIFGDVSSALIGLRNLVMPLRNFHYHELKHIVFVGSIEYLKREWETLHNFPKVSILPGTPLSRADLRAVNINLCDMCVILSANQNNIDDTSLQDKECILASLNIKSMQFDDSIGVLQANSQGFTPPGMDRSSPDNSPVHGMLRQPSITTGVNIPIITELVNDTNVQFLDQDDDDDPDTELYLTQPFACGTAFAVSVLDSLMSATYFNDNILTLIRTLVTGGATPELEALIAEENALRGGYSTPQTLANRDRCRVAQLALLDGPFADLGDGGCYGDLFCKALKTYNMLCFGIYRLRDAHLSTPSQCTKRYVITNPPYEFELVPTDLIFCLMQFDHNAGQSRASLSHSSHSSQSSSKKSSSVHSIPSTANRPNRPKSRESRDKQNRKEMVYR

SEQ ID NO: 166 - DNA, 783062 bp, Homo sapiens
  misc_feature (1)...(783062): n = A,T,C or G
cccaccacctgcctgttagtacctgagcagtgttctcggttatcagatggaaaaacttgtatatactgtgtgtagagttcagtgctatctgcggcttcaggcatccacaggggttctgggaaggtatgccctgcagaaaagtgagagactactgtatttatttacctgctacttacagtgatgttggttttccaggaagatagtggtatagaatttccttttgaaataaatttaggtaaataaaagtagtctattgaagacaaatattagtaagtaattgaaaaggcagtatgacgatatggtcaaaattgtgaaggtggtctaagcattagggaaatatgtgcattgaattttgggacatgtaaattgcccattatggtctctggcctcaactattattcccctagaaggaagggcatgccctgcctacatgctttttctctgcctaccacctcagctcccaggcagtgctgatctcaccagtcttcatggaagacccagggaagagagagccgagcgagccctctgggcagtgcgatgtgtgcctgcattctgtttagtttgtaaattggttctgactcaaataatatcccccattgaatttaatggaacatcatttcaatgggccaccacattatgaaccattgaagttaatgaaaagtcatttcaatgagctaccagattatgaaccattgaatttctatactaatgataaaggggctggaattcccttctgggtcattgtactttaaatagaatatgtattaccttctgaaataaaagccacttatgcataccaactcatctatctcagtagagtgtcaccaagacagatcttgatagaaaagccaagagcaagtcaaatgaaaagctctaagcccatgaccatatatcacccagggagttcccagggctgctagagcagtttgcaggttgctttgttcaacttacagctttcaattttgttattaggagagaagaacaaaatgaaatttatagataaccaaaaggatgtttttgcacgctttcaattcagtgtagcatcttgcagaaaatgcatttagcacagtgtcctggagctcacagaggctttttctgaagggaggtctgagacacacgctgggcagtgtctgcctctaacagtctccctgttccagctgcatagtgctgtaggcaagccatctttctggaagcatctaaagtttgcgcttaaataagcccatgtcagaggtcctcagagagaaagagctggcgaggcactctgtggatgctaccaaattgtagtggctgcagtgctcagagaaacgggaggtcatttctctttgtgtttggactttctagaatggccaggaagatggcagggtctctcccaccttcagctctctttctggattagtcagatgtccacgcaaaatccactggggaaatttccctggtgggagactcaaagactcagtttctagccaaaggtgaggatctacctctccttcctggctccaggcagcattcctagaatggtgattcttacattctgggactctaacagcattctgctgaaatatggtaagcgccttctactaggacctttactgaacttccctcttgaacccagaaaccagtttattggtctgtatttatggcttttttgcaggacactgctagattgggtttttgttctggaaggaccccttcactgttttattatttacccccagggccattaaagtactagagattgccagctggatacaacatacccgagtgaagccgtgaaaaggcttcaggacaccagagttggaagcaatgccctcagctcctcaatacacttgcaaggccctgaaagatctgaggttcctctttaaggggaaaggacatcaagctccagatgatcctcagtgagagatattgtcctctcaatattcaagagtcacctttctaaagggaacctctagattgttcatcagtgggacacgacagaggcaaaatcctgcccctgtctcccttagacctggctggataccgctttcaccaattcatggacccaagtcggccctgacagctagcaagaggccaagacccacagaaccaccaccgcccctctgtcagcaggaagaagttgcagaagactgaccttcatccattttcccccaaaggtttaggatcttggactcttgaggggggacgtgttatagtaggtagccagtcaggtatgagcaaggcaggagagggctccccacaacacacttaggagtggtgggcaaccatcaggtgatggtcagggggttaactgtttctctaaagtaataattggtcacagccagagccagggaacagcagtctcctgacagatagaaaacagctgaaactgatcagcagcttcccaataagatctcaggagtggggagggttaaggcaagatcttggaagtaggccaaagtataaaaccctgtgttagtttgttctcacgctgctaataaagacatacctgagactgggtaatttataaaggaaagaggtttaatgaactcacagttcacatggctggggaggcctcacaatcatggcggaatgcgaatgaggagcagggtcatgtcttacatggcagtaggcaagagggcttgtgtagcggaactcccctttataaaaccatcagatctcataagacttattcactgtcatgagaacagcatgggaaagacacaccctcatgattcaattacctcccaccgggtccttcccacaatacgtgggaattacgggagggagctacaattcaagaggagatttgggtggggacacagccaaaccatatgaaaccccaagtcaagaggtcaagctatgcacttggtttctcaagctgcccacttgaccatcttccaagttgtactctccttcttctctttcctttccttcctttccttactgttctaaagcttttaaataaactttcactcctgctctgaaaaaaaaaaatgtttatctttgcaaaaatatagcaaaagcagaatttcctggtttcacagaaagagccttacctttcataaaagcatcatggtttataattttttaaaccatcaaatgatcatctttgggaagcagggtgcttggcaactgtgggataacaaggctgaagaagggatgcaccttccagggaggccactgtgaaacaaagggctttaaaaaaaattccatttttatttttgatttgagggtacacgtacaggtttgttacaagggtatattgtgtgatgctgaggttagtgcttctattcatcccaccatccaggcagtgaacacagtgcccaataggcagcttttcagtccttgctccccttcctccctcctccttgtggagtccccagtgtgagtctattgttctcatctttacgtctgtgtgaacccgagagttgattcccacttacaagtgagaacatgggatatttggttttctatttctgtgttaattcacttaggataacagcctccagctgcaaccatgttgctgcaaagaatgtgattttttttttcctggttgcatagtattccactgtgtacacacactacattttctttatccagtgcaccatcgacagacattcaggttgattccatgcctttgccattgtgaatagtgctgtgatgaacataaaagtgcatgcatttttttggtacaatgacttattttcctgaaacaaagggaccttgttttggagaacattatgacaaaagcagacaccaggaaagcaagtcagaattggaagtaaatgaaactcttagagatgttgtacttcctgacttctctccttattcccaagagggtttgtaagtgggaaggatgatctcagcattgttcttacttgcaaatattgcaaaagctaccaggaagaggcaggagtaagtccctgcttcatctgcacagtcccttagattgcggtcattggattattttggagcactaggagtaagaagtcaagtcctggactgcccaggcattgaactagagcttttgcaaagattaaatcaggaatactctaagaaaaggattagaaagctttttggtctgtcagtcaggaagacaagttctgtagcactgaggaaaatctttttccttttggtgccttcttctcccactagcaaaaatgggtggactgatttttgccctgcctacctcccagaggcaaggcccacagtagtggtgttctgctggggggtgacactgatcacagagaggaaagggacacaggaatctgcagaatcgttattctggaaatcctgcagaatggtggtgaaaggtgaattctaggcagggcattgtgcctgagctgtgccttctttgacctagccatggatgtcctttggggaatgaagatgatgttcttgcaagtttgtatcttggcaggcaggtggcgcaatgattaaggaggatacgatgagaccacagcattattttcttccaatgcactggctttgatgtgttagaaaagaagagaattactttgcgggtaacatgccctggctcaaagcttcttcatcacaattggctgatctgaggccagtgacctggggcagggctgggaagtatcccacggccagactgactgccacaggcacctctttcctacacacacctgctctcccgaggcactggagacaggatggaagcatgtcagtggaaatcttctggacatcttttttgacaactagaagtcatttgcacacagttttataatttattttaaaacatattaaactttggaatcatctaaatgccaggagtatgccatctactgaaatgttatccaattatcattttttaaaatagtgttttccatgatatttaatgacttagagaaaatgctaacagtttcatgttaagggaaaataggataaaagttagatgtttaatctaaccctaattttgcagaaatacacacccaaggaaaaggtatgagataaatatataaaaatattaatagtggttattttggggtggtaagattctatgtgacatattcttttttcttgtcactgacttgaagcttatatgaaacttttatattccaaagtttataatacatatgaattattcttacaagcagaagtaaatataaaataaatatctataaaaatgtaagcatgtgaaagcttgttctgtaagtcccactctccagcattataaattacaaacagataaatcacttcagaggtaacagactttccttgtcgtgccaagtaacctggcagagctaagcctcagttttctcacctgtaaagtgggaaaatagctacagccttttttttttttttttgagacagagtctcgctctgttgccagttggagtacagtggtgcgatcttgactcactgcaacctccatctccccagttcaagcaattctcctgcctcagcctcctgagtagctgggcttacaggcatgcgccaccacatccagctattttttttttttttttttgagatggagtctcgctctgtcgcccaggctggagtgcagtggcgcaatctcggctcactgcaagctctgcctcccgggttcacaccattctcctgcctcagcctcccaagtagctgggactacaggcatccaccaccacgcccggctaattttttgtatttttagtagagacagggtttcactgtgttagccaggatggtcttgatctcctgacctcgtgatccacctgccttggcctcccaaagtgctgggattacaggcgtcagccaccgcgcccagccaatttttatatttttagtggagatggggttttgccatgttggccaggctggtctcgaactcctgacatcaggtgatctgcccgcctcagcctcccaaagtgttgggattacaggcgtgagccaccgcgcctggccactactgcacttttttacttcacaaagagactgtgaagaccaagggtggttagaaagagggatactgctgactttaaaagaaaacacagtggtgattcaaggaagggcagggttactggtggcagtaacagttgagatctgacatcaagtcatagtaataacatgaactttgttagctgcctttatccacaacagcttatatgctggtaggactggtaactagataattcatactgttgaagctgtagggttttgttgtttttttatcaatttttcttatttttttaagtgacaaaaagtgtgtttatggtgtacatgatgtttcaaaatacacatacattgtggaatggctaacttaagtaaattaacacatgtattacctcacatacttatcatttacctgtgatgagaagacttaaaatctctcagtggttttcaagtatacaaaaaaacattgtttatccacagtagtcaccatgttgcacaattagatctcttgaaattattcctcctgtataactgaatttttgtatccttggaccaacatcttcctgatccatgcctccttcctactccctgtagttttttttttccagcagggttttcctcttggaattttcatatctcaaatttcagactgttaaattaagtcccttttttgaacattcatgaaataatgtcatgtgccaggaaaatccaccagagggcgctagatcatttaaagagtcaccacctggcttctccatcgcaaaatcgcgaagattgatgtcagagtattggaactaggtccaggttggaggaaaagaaaatccattgcacattaattgcgatgctggccaacattttagcaaataatcttttttgttctccttttaccttagtcactctgcttttttagtatgtatgtttatgcacttccttttacttcttttaaatcagttaggactgttcagattagaatatttaagcttgaaacctctgatttgctttgagagctgccatagacacacatgcacatggtacagaggctgcccttctctctgggaagcttttgaatgaatttagaaataaaaataaggctcgtggtgttttcagaacagagggtgaagtttctacttctgttgagactttcagttcttgtgcaatggacctcaatttccagcctgcagacacacctacattaggggaagatgtgctgggcttagagtgcttctctatacctttcccatttccaaggctgtccagggactggcaagaaaaggagtggtgttgggtagtcagagagctcatttaggctggaggggctctgctgtgccctggagtctggccacagtctggctgtggacatgctgtggacagcatgacatgcaggcatgtgcacatacaattacgagctcaggggtcagaagatctggttagacttgcctgtccatttttggggtcacagtaattatagttaagatctgtataatatttccttccttcctttttcttttttctttcttttctttctttcttctttctgacagtttcactctgtcatccagactggagtgcagtggtgcaatttcggctcactgcaacctccgcctcccgagttcaagcgattcttatacctcagcctcccgagtagctgggattacagacatgtgccaccatgcccagttaatttttgtattattagtagagatggggtttcaccacgtttgccaggctggtcttgaactcctgacctcaggtgatcccaccgcctcagcctcccaaagtgctgggattacaggagtgagctaccatgcccagccttctttttcatcctcacatataacccttcgaggtaggcagggaagtttctggctttattttgattgtataaatgaagaaacacatcaaatcaaagatacctaaggttccttttaagtttgaggttctgtctgtgcagagccttttcctaaatttgtaatgccaggggccaagttttctggaagtggtgcaaaagtttgtgaacaatgtggaaatggccagagagaactgggcaaaggcctgggaatgtctatttctggtggatggtagcactctctcagtgcttaccagccaggccattcagggaggaggtgagagactggggattgtaggaaggaaaggatattgacatcaacactgagagtttctgatgattcctgactaagccgaggctttggacagcacagaagttgctaaaagcttcaatcagcagaggcaggggtgatgaagagagcaggagatggcatctgaggggcctccaagcaccctctccaaagatgctgaggtgatgaaggtgatgatggaggagaaaaagctatagatcctgcagttggggtgacagaagtcacagccatcggctgcttaccagtagaccccagactggcatttcaggggaatccaggctgtagggaatgtctaagaaggccccagaggggatttgctggtttgcaaaatttcaattttgtgggtgagggaatccattctggaggtttcatatcccactggggagacagtcctatcctttgctgccctttttatgttctgggtgttttatttttaaatttcaaatcttggccttgatttaaggaatgtccttaactttcttggcattgctgaggcacaaaagcagcaaactacagccattgagaggctaataaataaaggaacctcaatgccatagtcaccttcctgtgcatccccacagcacttctgggtcccgctcccccaacccagtaccagaaaaggcccagggcctttgcatgcttgggtctggtgtggcagggatgcattcagagtggctgaacacagaggccgaggttggaggtactatgggatggtatggagaggaggctcagacaattccattttctggagcacactttctgcagctcccttttacatacacttctttttgagaaccaaatactcaagaactcttacctcattccattttctcctttgactttggccttgactctttcttagtggatgtgtactctaaacccaatgaatgtattccgaatcaagcaagagagaagcttcaaacatcctcttcagcctctctgcccagctcagcctcccttgctcgctcttccttccagagacctccaaggacaagggcagggctgatctgactctcacggagacagcctcaggtgtaaagctaaggatgctaacttgggccttttccatgggaagagctgaaaggaacctgagaattccaattaggcttaaactaatgagctggaaactttggggaaaccactgcagcaatgagggaagagcgtgatcatcttcgatttaattagcgctggaaaaacttggggtccagctggtagcacgaggacggacgctgttcagggggcgcaaagtttctgaaagtgtcagaagggggattcccctggtggtgtacggagacacgctacggaacaaacacggactccttcttcatcttaagtggggagaagggaagaccctaaatggggaacggtgagccagaatgaagtctggagtccctcttcccccatctgccctcctcacaggatggatggagtctgagactatatgagaggaaagcaacccttcagggaactctattgtctatcggggcctgcactatccccaggccaggtcgtccttgatcatttctgcctactctttgttgggcagcctctgttgctaataaggaaaaaggagagaaaccacctgctgctgtcagaggccacagaccacccgctggccttcctgactctaccctccagccacacgcgggaccctgggcacataggtagcaggaagagcgaagtaggggtgggtagctgtgtgtatcctggcgtggggtcctcctcactcccgaagcccgagggtcctggggagctcagcctgtggaatccagttgacagctggccactcctcccctccccactgggggctctttggggaaaaaaacggcctgaccggggcgccccgccgtcctcccagtgtaccccaccgctctcggctgggggcgcagcaccttggagagaggcgcctggccccgcgcctgggctgggggcgctctaccttgcgccctgggggtcaggggcgcttgccgggccgctgccgaggggccctgcccacccctgcccagcccggagcccaggcgagccagcgcggcgagcctcctcccctcccgcctgggtcgtcctgagtccgcgcccgctccagttgctgcagctgctgctgctggcggctgcggggagcgcggggcgcgcgccgaagaggcttgggcggcgaggacggggacgaggaggagtcggaggcggcaaggaggaagagcgagcggaggccgaggggctcagcggcgtggcgacaggactagggggtcccgagaacatgggctagcaggcggccacgggccggcggccggacgcggtgaacctgccgcggccgggcgcgcactggcgcggcgagccggagccgagcgcagccgggggaggagggctggcgcaggggcgcccgggcggagggggccgattatccattattaacgagttaccacctaataagcggagagcggctcgttagccgcgcgggaggcgctcggggaagggggtcaccggccgagcgcagcgcacacccgtggcgcacggcgggcggcgcggcgccgaggacacccgggaccgcgcgcggagccggggcgggcccgggggcggcgcagaccccgggcgcgggcggcccgcggcgccccctggctctcggcgctcggggccagcgcagcccggggcgagtggggcgcgggccggggagggggagctgcccgcgcactccatccccctcccccccgggcgggcggcggcggctcgctgtatatatctcggcgcaccccgccaggtcgcgcacagcgccccgagcccaggcgcctccccgcccccctcccgcgctccgcggcggcggcggcggcggcagcagtagcagcaatatggctgttgatgggtgtttggggtggcgctggcggcgggaggagctcccccgagcccctgcgccggctgcccgttgctagctatggcaaatggtggcggcggcggcggcggcagcagcggcggcggcggcggcggcggaggcagcagtcttagaatgagtagcaatatccacgcgaaccatctcagcctagacgcgtcctcctcctcctcctcctcctcttcctcttcttcttcttcctcctcctcttcctcctcgtcctcggtccacgagcccaagatggatgcgctcatcatcccggtgaccatggaggtgccgtgcgacagccggggccaacgcatgtggtgggctttcctggcctcctccatggtgactttcttcgggggcctcttcatcatcttgctctggcggacgctcaagtacctgtggaccgtgtgctgccactgcgggggcaagacgaaggtaacgcgcgccccgggcgcccgccctctgcgccagccccaccgcttctcggcgtcccctgcagcccacctcctcgctccgcgccgcgccgtgcctccctccatccccgcctgccttcccctcgccgccttcccttccctcggctctcccggtgctctcggatcggggcagcgggcggcgcgccgggggtgaggagttgcccccagccagtgcgctccgggacgcggacgctcaatcctgtcctcttgtttattgtagggttgttggcggctgcggctggggccggggtcggggactcacaggctcgggtgccgtggtgcggggtggggacagccaactcagcggggacggaggaagctgggggcagctgggtgcgtgttttgcaccgctcacctgccggggctcggctcctggcggtgggcgagagggagcacatccgcccatactttaggaacctgttggggagatgagttcgtggggtcagaaagaagggaaaaatcctttgggcaagggagagaataattttgcacaagggaatcccgggggaggagcatggcccgagataacagggggacttcgaggggcgagagaagttggggagatccatcccactattgggggtagcccacggggctgccacttttggaatgtgtcgaggtcgcatatctgatgtaacctcccactccgtcccttaggtgctctagtggaacataccccaagttcttcggcctctgttcctttgcccccaggccacccactttgggtccccggaaatgccaccagcagcgcggagctggagcgggagtccgcctgaggccgcggttttacgcggagcgtcttccctggcgctcgaggtggctagatgtcgtcggctttagctattcctggtgcagacgcccaccggcactgaggctggcgacaccttcgatgtatggttgctaggctcactgcctggtctgtagtcgtgtccctagagatgtcttcccttccccacagccactggctggagtgggggacccgacactgatagaaaactgcagaataaaaaagaaagaactggaaaaaagagagtgagccagctgccttctttctgagtaattcccatcctaggggacttcacgcgcgaaccgttttggagggaagggaaatccaggggaatagtgcagggtagatacacattgcagcctccacatgttcacatcttttctagtaaagttaaaccgaggacccctcaaacttctacagggcacagcaacttgtagcagcctccttggcggctgagagaagtagggaagcctggggctatgggtgaaggctggctatgaaaacaccaggggggaaggagcctgtctctcctgatcattaattatacatcctgttgggtgctggagctcagctgtgttttgtggcagcacatttgtgttttggaaaatactggtgtattggaacaaagggagaaatatgaaaaccatcattctcttcgtcattctctggcttctccggaggcctgcaggtgctggtcggagagttttctttggaattaccttctcagccgtagaggtttcttcttatttgttaaggaggcaaacctcccaccttccagagaagccctcaggttaagcaaagccctatacaccagatccctgactagccttcctgctgagaacagcttattcctggagccttcaaattcccacattccctctctccatccttctcctccacctcccccaacagtctcgggaattttgttccccggtttactgagattcagcgactgtctttaggggaaagatagctcatagttgtgtgcctctgaaatgttccctagatagagtgatctgggtgaactttttaacagcttgctttctttcaggcagggggcaatttttatcataatgaaaactttttcaatgattgaaaataagttgtggtgtttttgtgaacctggggtcctaaacacagcttccaaagtctttttatgttagggagtacataaatgcaattgcagtgtctgtaatgaaatgctaatcccatcgcacacacaaaggatctcctaaatgatgagcaagcataacttctgtcagtttactcaagaaaataggtttttggcaacgattagaaaaaacaattcgtaaatatttggctatgttttgtagccccaagacctgctgagtggacataactggaagtgagttgctgtaagaaatctgccagggatgagaggtgatggtggtttgtttggaagatgtgaggccagtatagaatgagtgcaggttccttttgataccgtaagtccattttaaagcacacctagaatctcttgatacctgcccctagatttgctcacttaagccataggtagccagctcattatatgcagtaacggtaagttaggccttttaaaagcttttctttctatgcttgaggtctgtatttttattgcaattgtgtgtgtgtgtgtgtgtgtgtgtgtgtgtgtgtttgtctttttttcttttttctttccaagtatttggtagttttgtcaagactcgatacacaggcatgtatttggcttaagcttagaataataatttttgtgctagatttcccaagaaaacataggctgcctttccagaaaattctaccagccctcagatgggttcaccctcaccctccttcagccccaagatggtttgatcaagagctggagtccagaggaaagcaggtcttttgtagcatctgaaattctgtgggagataaaattcagcaaggagctccaatttcatgagcgtttggtctctgggatcgcaccaaacctttttgatcaaaggaacccaagactgtggacatgcatcgtgggacatctcttcattagtacctttggcctctgaatctcaaacagtgaatgactttagtcttttgaaaagagtggcatgtggactttttcagaaagtgaagaagaaaacattacaatttcctcctgttgggaacttggtcacagtcattccagtactgtgttctttgctgtactttttcacattattgtttttttccttgtgggatttcatcagagctctctattcacttgggtgtgacgttgtgaagttcaatcctgtcatagactatattgaatagggagctgctctggtagcctgaataaagccatgactttgaagaagttatttaacctctctggtgtctatctttccttgtgtataaaatgtggggattgaattctgtgagttctaatgtcccttcctgctctgtgattcgatataggagagagggaggagttgaggaatgagggttaaagtttctagctcagaatgtgttttgcagttccctagcaattcctttaggaattcagccttgggacagttacatatctttatttccatcttctgctcgtcttccagcatgtggtctacttctctttaaataactggggaaactgaggccaacttcctgatggagctgtggtttgttgaggggcctgagtgtggctgggcatagagttatttccattctcagtttgagctgttggccttgtagaagcttgggcttgatcaaggatggtctgcgtgtaatgaattatcgagatgttgtctccatggctgtgcctgagaaaacaacacgttttctctgtcaggctcgtgactaatataaatatcagatcccattacagcttggtaattacccagggtctggtctgacgcattcaatcagggctggagcttcagtgccgtggagctcttgattccagattggcccttgtgcctcatctcatcctgtcctggggattggctgcaccagatgaccttgagatactcctttttgagcagatcacttggggtggccttggaggagttcttgggtcctagtcacgggggagctccagctgacctgcccttgtccagagagctcgtgctcctcattccttgctctctctctctctccttttattaatttttttttttgagatggagtctcgctctgtcacccaggctggagtgcagcggcacgatcttggctcactgcagcctgcgcctcctgggttcaagcaattctcctgcctcagcctcccaagtagctgggactacaggcgcacgctgccacacctggctaatttttgtattttaagtagagacggggtttcaccacattggccaggattgtcttgatctcctgaccttgtgattcgcccaccttggcctcccaaagtgctgggattacaggcgtgaggcacggcgtccagcccctggccctctttatggaaatgcacactttagtacaagactctgcaatcaggcaaacccaagttcaaatcatggatctcacatttattagcagggcatctttgactgccaaccatgttgagctttggttacatcacctataccaagagcatactgatgcttactttgtagggttcttatagggagcaggaataatgggcacatagcaccctgcaaatgccagacacttagcaggcctcttgtaagtggtaactatcatagcttcatgaagtgctgagtttattttccctttgattcattgaacttatagcccctgaagggcgcagactataacaaataaagtttttgagccaaaaggaggctttagatcctgaagtatactgtcatagatcaaaaaaccatttagagtcagactgagacatgggcttatggctcttggctgttgcaaggctggaaagttagggcagggcagcagaggtaggcttcacggatggggtcctggcaggatggttacagttttgatggtggggtatcagtggacgaacatcgacagtatgggggaccaggagctgctgggctggcagaagggaaacactgtggcatttggtgggcaggtatggttgtccagcattgtacccttgaggagggacaaattccatccctgttatcccaagtccagaactcatagacctgtctcccaagtgatgtcacggtctcttggccaggacactcactgtctacccagaccagcttttccaagacaccccctaggccaggtttccccaagtgtgttctgtggcacacctgccttttaaattaccttgtgaaaaaaaatcagcaggcatggcgtggctgagcttcccctttggagggccacatcacaggcttggcggcatcctgctggtagagaaagtggttaaaatgccctcaaatgtgctacctgtgagcagtcttgcttcagtgtcaggggtgctgtgcagtgcccaaggttcagcctgtgatcctgggcaaagacgtcatgcctttgtgcctcagtttcctcacctgcaaattgaggtctgtgatagagcacagcctcatggggtggtttttttcaccaaccccattttatagcatttcctaggaggacactgagaacctatggcctccctttgggagccttgggctagccctgcttctaggtgcccaggaaacttgaccaaacatacatcaggaggaaaagaagagctgcctgccccctgctgtttggcctgggggataaagcattccaatggtaagtccaaatggaccttctctttgcctcacagctattttgttccctggatggggacattcattggtggctgatagccaggagtaagtgcttgctttggggctgtctctctctttctctctctctcatcagggcatgagaggcctggtgcagaaacagttacattggcattcgattgcaatgccaggacctccttcccaaagtgggcgtcccggctcacactggcagtgaccatgctaatctgtgaatcacagcagccaataccaccttgccaagctgcagatcccctggaaggtcgcctttgtggttccagtgaaagggctgtttgtgctgtgatgccaggccctgggccgtgtggggaacactgggtcccttggagacatccctggggatcagacagggccatgcctttctgtgcacagtcagggagcagaccaaggatgtctcttttagaactgcttcttgggtgggtggaaccccacgcattaggcacctagaaaaggaaacccagggaccctcggaggcaagggtgtcctagcactttggacagaaaacctggggaatgttcagtgggaatatcacatctttatctccaaggactggagagtgtctctaggcctgggcttctcaaactttttttttttttttttttttttgggacagggtctcactctgttgcccaggctggagtacagtggcatgatcactgctcactgcagcttcaacctcccaggctcaagtgatcctcttgcctcagctccccaagtagccaagacttatgggtgtgtgccaccacacctggctaggttttaaattttttacagagatggggtctccctatgttgcccaggcttgtcttgaactcctgggttcaagtgatcttcccatcttggtctcccaaagtgctcccacagtggtgtgagccactgtgcctggcttagtcaaactttaatatgctcaggaatcaccgagagctgttaaaatgcaggctgtgattcagaagatccagtgtgggacctgagattatgctggtctggcgagacacaggctatactgatgctgtgcagaccacactttgagtatcaaggatctggtccatccctcagcctccgtgcagtccatccctgaagacaggcttatttttaaatgtggaaattcccagctcttgaagggggaagggatgagaagcagaaggtttgctctgccagatcgttgggtggagaaaactcctttcagaccagggtagctgtggttcgggctgggctcttatttgcgaaaactgatggtccaggtgcctgctcctaaggaacccatcagcgttgtggatttagggttgggttgtggtggccagagcagtgtttacagggtgtggtctgtgtgttacccaccaatgtgtgggctcttcctcgtgccagttggtcattctgcaaagggtgtgacttcccgaagtccaggagggcaacccagccaaactacctccttgcaaaattaaaggctggtggtgtcaccagggctgcactgcggtgatgccccaggctggctggggaccactccctctggagtgtttgaagtcagtgggcattaagactgccagcctgattttctgtaggggcctgggtgggccttcccaaatggagggttcaacctcaaagaattggctgaagagctgcccgtggagtgactgggggacacgcgtggcaccgtgctgtgtggccctccaatgcacttcttaagaattccagaagatgaaagtgaaagtagctccttttctcaccataccagggtttttcacagctcacactgtcagggactttttccatgagatgtgctttttatgttgtttcatcatcagaggggagcaccatgagtgtctgcagcaggcagaatgaagaaggacctagcatcgtggcggcctgcacacagtaggccctcaaagaagtcttctggttataattattgttgttgtttttgcttttgttgcatattaagtgtatacgatgtgccagaaaccaagctaggtgctgggggaaaaataattaagacccagttctgactccctgcttgttagggcttttattagtacttgacaggctgagcagaggaaaaaacagttatcttctcatggaatatgaacatctgatctctgaattgcctgcaaactccttgagggcaggaactgagtcatgcaaatgtaaacacacgtagatgttggaaggctctttccagtagttagctgggggctgaacgagaatgcattggttgggggtggcaaatatattttcctgcttttttgggtaatttgttagatgctatggagaaactcctggtgaaagagatgggcttggtttgttgacaacatggtgcttgaatcattcgtggattttaattattcatgccacctggtttctcttgatcagtagctaacaaggatttagttcataatgggcagttgtttgtgaggtggatgagtcaggcacgggagggaagggcagtttcaaaagaatggctgctttaagatggaacttgctttgtttttggcattatttggtgattgtcttgggacattgtgtctaattgccaatttggaaatgtaattggcactccaggcccagaatggatatacacttaacgttgtcaagccgagccttggaatcatctccctgtaagatcttgttacctgtatgactaatacttcttcacgtggccaaaatcaaaattatttaacacatctcctttattttctattctttatgctggttcactggcctctctaccagattttcttggggactcagatccagtggcctctaggcatttcaaagcgaattcacaggaaagcctgaattccagccttctccccctcctcctcttgctccatcctttcttttacatccttttttccttagtggctgtcattcctgagggtttctgtggaaagttggtgctgtttaattttggtttctagcacaatagggaggaatacttcaatttggggaagaagtaattaaggtaaacattatgtagatctccccattatcagagttgacttttacttggggaaggggtgtttttttaaaaaggaaaaataggattttagatttttttttttttttgagataccgtcttgctgtgttgcccaggctggcaggctggagtgcagtggcatgatctcggctcactgtaacctctccctccagggttctagtgcctcctgagtacctggcattccaggttctcatgccccatgcctggctaatttttgtatttttaatggagacgggatttcaccatgtcagtcaggctggtcttgaactcctgacctcaaatgatccacccgccttggcctcccaaagtgctgggattacaggcatgagccaccgcgcccggcgagattttaggtttttgacttgaagtgaagttaatttccatctgttaactgctgaagtctgggaccatgatgtcttttgcaaaagagtttttaaggcaagactgtcagtaatattctttccagggtcacttctaactgtacgaaactattcagccacgatgggtctgcatctttgcatatcattgtaaaccaaattatctacaggctgttgggctgcctgtatgtgcatttcaagttgggagtataagatgagtatttattttattttctggttccatgtcttgttcttgctccttcttcccttttagagactggacagtcctctctgtcttcatctttgggagtgaactggggctggggggtgggatcgagagtggcctctgctggctgggggcttcaggtttgtagattagtagacaacaaatagcgacctgatttaacaagtgcagaagcgcatggaactataaattcacagtggtggaaggaagctttggggcctcaggccctgtgcgattcctccccagtgctggaagcccaccctaccagtgtgtttatgatctcctgaggccactattccactggggacaaacccaccttacgatgaacttggaaagatctttctgtttgcactagtccttgtttgcttctagtctgtgtctgggacatgcagaacaagccttggtggatggtagatttcaaattctaaatccagttcaggaagggacagagctgggtggtgtttccatgtccgcagtgttgagacgtagaatgaccttaaccttaacttgtgtttcctccatgaaggccactttatttttctccctgatggcttccctgggttcttcgtcctcctgagacagtgtggtttccctttgcccctttgcccagagttcagaaaacgacccattctggttgtttcttgaagtttgccttctgaggtctcttcggtcttgtcagcagctgtgactggaggcttttgactgttgctgggccataaattcacctccttatcaatgtcacatgccttgtatctccaaggtttagcccccttctcagtttcacgtgggggttgtaatttgggggccctgccaagaatttggatgtagggtacagagcctttgttaggaaactcgagttggattccattttctaggtgttgactctttttcacctagggagacagacagtgctcttgaacctctttttgcatcacttgaatacagccgcttcttagaataggaggctgtttctttcccacctgctcattgggtctcctttcctctggggctcctgtatgcctctgctgtcatctcccctattttgctgaacagaaagaaaccagaaaagaaaagagagcaaaacacacaaaggaagaaggtgagggagggcaggaggtagagggagaggttgacaccaaggaaaaaagaatttctcctctgagagttagaggttggataaatagctaattggatggattttggttttagttacctcacctttgtcttaatgaataaatcatgtcaaatgacttcacctccaaggagtaaagcattctaccagtgggtagaatgagttcacgtttggaaaattttagctcttcaaacgagacattctgtggaatgaactgatagcacgcggcctgtgtggctcagaggtgaagcgttggaagggtttgtgggagatgttctttgtgtgcttgttaaccaagagcagaattctgctcctctttgggagaagttgccacattgacgttgttttctctttatgtggttttggaaagtggaccctttgtggctctggaaggggaaaaatgggcctccagttattcaaatggagaactcagagataagtgttctaaggcttggaggaaagatttggaagatgaaaggccttacccaagtgctagggatttttatgaccaacattagctggcaacagcttaatatacattgttgttctccttcctgcatctgggaacactttcctcccagagcttagaggaattatttcagctgcccatgaattatggccgtttctcctgtggcttgtggcagccacagccgatcaggtggtagattcttgaagagtataggaatgatgtctctagctgagcccacaagagggctcaacagtttgcctcagtctaaaaaaaaaaaacccaatcatttcttaagttctttcacaaccctgttttctccataggatttactttttaacttcagtattttatattttgtccttaatcccaaatatactacatgttcattgtagaaaacgtaggccgtgcaggggcattaaacaaaaaggacacagtcacatctgttaggatggctactgtaaaaaaaaaaaatagaaaatcaccagtgttggtgaggatgtggagaaattggaacccttgtgcagtgtttgtgggaatgcaaagtggtacagatgcggtggaaagcagtatggcagtttctcaaaacaaattaatcattcaattatcatataatccagcaattccacttctggttagatatccaaaaaacttaaaagcagggtcttaaggagatatttgtacacccatgttcacagcagcattatttacaatggccaaaggtggaagcaattcaagggttcattcacagatgaatagattagcgaattgtggtaggtacatacaacagagtattattcaactttaaaaaggaaggcaagtctgacacgtgctaccacatagatgaacatcgaggacatcagccaaatgaaataagccagtcacaaaaggataacttccacttacatgaggtacatagagttgccaaactcatagaaacagaaagtagaagggtagtttccagggccagagggagggaagtgtttaatgggtatagggtttcagttttgtaagatgaaaaagttctggagatgggatgcacaacaatgtgaaacatgcacatttttaagtgtgaagtactacacacttaaaaatggttgagatggtacttttttttttggcagagtctcgctctgtcgcccaggctggagtgcagtggcatgatctcggctcactgcaagctccacctcccaggttcaagccattctcctgcctcagcctccggagtagctgggactacaggcgcccaccaccacgcccagctaactttttgtatttttagtagagacggggtttcaccatggtctggatctcctgatctcgtgatccgcccgcctcagcctcccaaagtgctgggattacaggcgtgagccactgtgcccagcctaagatggtacatttttgtcttctgtgtatttcaccacaattataaataaacatttgagaaaagggaaaaacattcctccaaattccccctccaggagatgaccagcattatctttgggcacatttccttccctgacatgttctttacggtggcgttcttgttttctcggtgggcagctgatattcttcctctaaagattgcagcccctctagaagcacccaggctgactttgatgtaggccctgcccacattgagagcagacaaatgaagagaacaaccctctttctgcctgtggggtctggtttaatggtgtctactcttagagtgaagttaagggagcgccggatttttgattttgacatatgacaagtgactagctacagtgtcttagacaagtcataggctccaggccttagttttctcatgcatataacaaattctctgatttcatgatttcaatataaagccatttcttaagtcagattttaaaactatcatttttacctgataaagaaccaaagattaagttattgagggcagtgaatccagggagaagttcttgttctactataaaacacaagagtgaaatttgattgacttgtccccagaacttcaatattgactttgatgacatatttaagaattacaatctagggacacaggccccattggaaataccatcaaacctgtcatttaaaaaaaaagtctcagaaataggtttttgtgactctactattacttctaatgatatagccacaccactattgaggttttaattttaatttttggtgtgggggaatggttcagaacatcttagattatagactataaatagtgtgctatgataggctggctttgttgaggttgaacataaaaagaaacatctgattaaagagaaggtcatgcaaatcaacttactttgatccttttccttaacttgccccaaaacgcagccttggagatagaacgttcatctcagccctgttccacggagcattccagctgccgaaagcagggataagataactgcagcttctgtggcaaaagagcaagtgtctgaagggatgattcctaaatactcagtaacctccgaaaaaaactccccctgaaccgtaagcagccagcacatcagaacttactggaatagttctcttaggttacataacatcgattcgattatgctaccggagccatgcattaaattttaacttgtcacagatacattacattaacacttcacaaatccacagagtaccaggtagctttggggtgttggtaattgtgtaggacttgctgcaatccaggcaaaaatacttacttgtacattttgtttcttctgtactatagtttaactcttttcaggggtgcaaacatcctgcaaatattctttctttctttttttttttttgagacggagtcttggtctgtcgtccaggctagggtgcagtgtcacgatctcggctcacctcaacctttgtctcctgggttcaagcaattctcctgcctcagcctcccacgtaactgggattacagacatgcaccatcatgaacagctaattttttttttttgtatttttagtagagatggggttttaccgtgttggccaggctggtcttgaactcctgatctcaagtactccacctgcctcggcctcccaaagtgctgggattacaggtgtgagccactgcacccagctgttccaagtacttcttacaaaataaactaaaaagttagacaatagtgattgccaccgtagtactgaatacttgatttatgaccatggactagatatggcagaggtttttaaaactctgtgaaccttttcattttcccgtgacaggcaatgcaagtgctgtatttttaattggtccctttttaaagtcaggagatgaaatgttatcatgcaaatctctcctaagttgcatggaaactaataaaatcacgaaggtttctatttgtactctacgaacacagactgtaatgaaactaaaacagctatctccagggatgatgctatttaaattctaggcagggctttaaaatgattttcatggtgaaaacagaaactagcaactgagatgttcctgttctttcttcctcatctcaccagtgcctgttcacccatgttcctttttacttcctgacctcagaaaatgaatgtaaagcaagaacctccggtctctaagatagcctgtctatcactggttttagaaaacagcaatgattcctcctcaggtcttgcatttattttcagacttattggtacttttgttttgggaagtctttctgtgggaattggagttactattttcttaggggaaaaaaaatcagaacaaacttgtttgagtggcttctatgcattaagcattgttttaagctccttatgtttattctgttatttaatcctcaaaacaatcctgtgatgtagtccccttttaaattcccattttacaggttagaaaatggatgcatagagaatgagaatgtttttctttttttggataacaaactttgagtgattactgtgtgtctggttgtttttaaactatatgtattatataatcctcacaacaacccagtgaattcggtggtattattatcctcacttatggattagaaaactgaggcacagagaggttgagtaactgctcagggtcacacacaggtgaggagcagagccagtttaaatccaggcaggtgggctgtggatcccatgcacctaatcccacactgtacacctcatttatacctccttagctcttcctggccacagtgtgagggaaactctgatgacatagacaggactgaaaagaggagtggtgtgttgttcctggagagatgtgaggtcccttgacaagttcagagagttttgtactactgaattctcaggtatgtcaattcccaggatgagaaggaaccttaaatgttgtctagttctattacattccctgagtcttagtttttcttgctggaaaatgggataatcaccttttctctacctgacaggcagtgggctatatacagtcatgcaggttactcaatgtacaactccaggactgctatgagattcacatcagatgacatataaatgtattttatgaaccacagcacatgtgccacatctctgtgctggggggtatgtggaggcacagaatcaatattgggtcatttttctgagtgtcaacagtcttccatgaagttttggagaaaaacactatttttctctaaaacctccacctcctgggctcaagcaatctcccacctcagcctcctgagtagctgggacttgcaggcatgtgactacaggcatgcaccatcatgcctggctaattttttgtatttttggtggagatggagtttcgccatgttgcccaggctggtctctaactcttgagctcaagtggtccacctgcctcggcccccaaagtgctggaattacaggcgtgagccactgtgcccagcagaaaaacactatttttggtattaacacttacactgtacacagagtatattggaggtaggatgcagaatttaagtaggtttttaaaaacttgagagaggggtgtgtgtgtgtgtgtgtgtgtgtacatgtacgtatgtgtgagatgcacacagattcaagagagcatgggggaccagcaaagtttgcacccaccagcgaagtctcatcattaaaccatgggcctgtgcaacctggtgtggaatgatgccttattatcccacatgagatatgctcatatctcaaactctgaaactgtgttagtaaaagaatgggaattctgtgaaagagaaataaatatatccaaattccaggtctgttaaaatttagcgcacttggatgttggtgcgacagagaatttaatctgcacactcagaagaaggtagtggttaactcattcagtggttatgaatcttccttgccttagaaagatcaattccttgtgcctctccacctccgtggcctggaaatacattattatatttcaatatggctctctttctaggccattgcgcattgtggccgtgtgcctgccaaaccccgtgcatggaatatttggaagcaggagacaaattggttagttagcaaatctttattagcatggctggccttttcccggggatatggggtcatgtaagacatcatttcctctctggcaataccggtaaccacattgcatgattccagggcgccactcacatcctggtcatgaatgaagccctctggtgttgtgcagtgcacagcctgcatgcccatatacattgtcttttctaggcatctagctgtgtttgtgtaaaacccttacacaacaaattaaaaacacagtgcaaagcccataattcttaatggcaatgtgaataacagaaacatcaagaatttgggtttccaaaaatggggagaaaacagaactggccgtagagggagtggccagagagaacccactggggatgtggggttatgacggcagccccagcatatcctccaaatccagcctctgcaacaggcgctctccctaacttctgatcactgtgcagctcctgacatgatacaagaggcctcccaggcctctgtgcctgttctaagcatgagccttggagaagagagaatgctcagtgccagctcatgtgtatcccatggacaaggactaataggaccctgaggacttagaaaagccttctctgttgccaactgtgctatttttacctccctcccacagctcctgctttccccaggtatttgtcagcagagcgtcttgcacctgcatggaaagtggcagttggggcccaggatggccttgtgctgtgcaggccacagcagtctccttaccaggcctggcggccaggcccggcggccaggcccagcctctgaggctggcaggctgtggtgaggatggttgcataactggcctttctgccgctggttctgggtgaggtcgagccagagaaaacagttctgcagtcgacagcccctcctgggcactggtgcaacagacaggcttgtgggcctggtgctgacccctcacggtcaggagccacccttgctcttgagctgctgatcatcactgcagagtgcccaggtctgatcaacatccctgctgggaaaagcggagatgacctggcgtggtccatagtgatccaaatgtgatagaaggctgggggtggccccagtgatggcctactccttcccttccaaccctccacctcctccatcctccaagtcttagctcatcttgctgggaatgccgccttcctgggaagccttctctacctaccctagtcagctttctctgcctctcccttccctgatgcgtcctctctgtttgtccttccatcctgggtggggagcagccgtctgatgctgcagccctattttctatacaggcatcctgtctcctctgcagacagctccttgtggacagggctggtcctggtttctttctggatctgtgcctggcaggtggtcctagagggcagtgaccaggggtcgctcaatgcggtggctggtcatcaaagcaggccctcagtgaaccacgactcctcacgttcatcctcttgggttgtaccctttggggcagagctagcccctgtaatccatgggttgcttgtaacccatggattgtggtggaaatgatgctatgtgacttctgaggctatgttggaagaaccctggcagttcatttgttatctgggaatgctacttcttagggaagttggccactacagggggaagagcgagagtgagaggaagcatgtgcgtgggcatacgagaaagagagagagagagagagagagacagacagacagagagacactactggggcaccacgcatatgtgtgaagatgccatcatggaagtggatcctccaaccccagttgacatagattggagatgaacccaccagctgatccctctatgaattccttacttaaaagtcataaacaaaatgaaatgattgttttaagccactacattttggggtaatttgttacatagccatggatgactggaacaaataattactatttagtgaagtcctttcacaaggtccagctcctgccctctttctaggttcctcttaacatcttcccaagctctccacacccagccacttaggacttccttcatttcgttaaaccttttgatttttacctctgggccttcacacatgctgttcacactgccggacttctcttttcttgtcctccttctccccttccacttagctgactcctgtttatccagggatgtgctggtaagtgattaacaacgggatttctagagaagaaagtccctatgtacggtgttcgtcaattcctatggtataaatattcctgccctggctggtttgaagataccagtgtgatgtcacagaacatagggtattgttatccatgattggcagttgtggaaactgaagcccagagcagttcagtcacttttctgggtagatcccaggcagatatggcctctgatatgcttggcctttgagaccatgctctttcctgttctcctgaagaaccagtagctatgagcacaggtaatattgctgctgggccatcctgtttcttctagacgagtagtcttccctctgcatttcttgagttgctgcaggctttaccttatgcttaccatacctggccagttgccagttaccacaccacgctgctggtttctctcctggaccatatttatggtatctagactctggtgtgtgcagtggcgatggaatcattgaggcaacagggacctgtgagtccatcttgaggtttgataaactgtgtattagtcagctaggccacctctgtaacaagaggtcaacatgtcaatgacttaatacagcagaagtttacatattgctcatacaaagtaccattgatggtgtgtgtggagggtgcagtgaagacacacttcagacagtcattaaagaccccggctcctttcacttgtggacctgaaatcttctaggggcccctgaaggtctctgctggaccctctgcatctgtccggatgataggggatgagaagtaaggatcatgaggggtagttttgtaggggtagttatggaagtcattcacatcacgtctacccacacagttcattggccagaacttgatcacatggtattttaactgcaagggatcctgggaaatgtagcactgcacccaggagattgaaatagatttggagaatacctggactgctgaaggggctcccgagtcccacactgagggcttctgctgtccatagctggctctgccagaaccattatcatgacccaatgagaaaactgaatgtttactgggtatttgctaggtgtcagacatggtgtcaagcactttatatgcattatctcaatcctctaaatcagcctatgatgtagatactatctgtatttttcccattttacagatgtacaaaaactggggcttgcaatggctatgtgatgtcacttgcccaagaggcatccttaataagtggcagtaccagcattagaacccagggttttctgtcttcagattgttaactcttaccctcttcctatgctgctctggagtgccttcagctctgcctcttcttatccctgtctgcagcttgaaagctactcagcttcttaaacaccttcaggataaagggactaaggggcataactgcctccctgcttcatgtttcaaagagattgtcactggtttacgttggccctaattcaggggtggtgaattgacagtagttacctgagcctgccctcatgatttgaatgcatcatctcccagtctgccctctcccactttgaatcttacctggcgtggctctttgcctggagcattgagagtggaaggctcatggatgacagaggctgcttcccgggtttcttgtctcactcctgtggtgatgtgcttcaccttggaaatgcacttcactgtagccccttctacccatgtccaattttatgtctcagcaaagtaagttcaacagttcactgctgagaaaacagggtctcaaacgtgagtagtaacataagtaatacggttgcctttctaaaatccaatggaccagaattgtaatgtctcaatgagcaacgtctctcattctagatagttcagtgtggtcatcagggacatgccctctggagccagcctactcaggcttaaatcatagttgtgttgcttgctgacctttggatcttgggcaagccacttcacctctgcatgcctcagttcactcacttggaaagtgggaataaaataatactgaaaacgccctcaaacagttcctagtatcaaattggcttttttttttttttgagatggagcttcactctcgtgcccagactggagtgcagtggtgcagtctcggctcactgcaacctccacctatcaggttcaagtgattctcttgcctcagcctcccgagtagctgggattacaggtgcgcaccaccatgtccggctaatttctgtatttttagtagagacggggtttcaccatgttggccaggctggtctcgaactcctgatctcaagtgatccacccgcctcagcctcccaaagtgctgggattacaggcatgtgccactgcacccggtcttcaaattgactttcaaatgctgggagatgtcaccccacattatcctcctgctgcctggggttgttgggaggatcatgtgttaaatgctgagggtagcacttgctacaaaccaagggctaggaaagtgttagttattactgttactttcatttggtcatctttgggagactgtgacattttcccctaatgtgggcattgacaataacctcctaggtcattggtcactctgtttctggtaagtctccactctagtccatccaggttggattgcacgtctgtggaatgtccaccccctgctggaatgtagcatctctgaagcctaggactctgtgccttccatctttgcatccacagtgcaacattttgaatgttcattttggtctcttaaattcagtcttgtgaggctcttagcctagtttggaattggtcaaaggcgggtttgagtcctggctctaccttgcattagcttggtggttgtggccaatttacttaaccttgcaaagctcactttcttcattggtaaactgtgaatactaaaaataccagccacgtaaaggttttgtgagtataatagcatttagcatcttgtaagtcctcaataaatggccctgttatgatgaagttggcctttattttagatccctctcctttgtcaatataaccaggattgtgctgaactgagggacaggagaccactggaaggggcagggtagccaggggccaacagtgagcaccaagacggacagtgaggtagtgctaaagatggaggcagaaagtagggttggaggaaaatggggtgagaaatgctcccttccctctgcctctcatcacccacggcacacccctataccactataggaaggacgagggagaggggaatggagagagaggaaaggaagaattttgcagtacgagatgtcaggcattgaaagggttaactcaggggcgaggcctcagtttgccacctgtaaaacggaggattggatgaggccattctgagggtccctggtggctccagcagtcccttgcatttttataagaattgtgattgtgctcctgcctgttctgcccctacaccacccaccttctgcagcctcaggcagttggagatgatgtcaaaaggaacagaaggggtggaaagtgctggagggcatggaatggtttctcccagaaggctgagggtctgaaaagaggcttagaagcctggtagccagagcaggacggacctggtggacccatctggtgatcctggggctgctctggggcctggtgaatggtgaatggaccagaggcaccttttgggctctgaacaaagaagaaaggccaggctccagacccagccctcctgcctggtgggctttttagttggcactttcccctatttaggaacctgtgctactctgataggctgaggcagcccaggcgcctgtgttaaggttgcttaacatctggtatttgtctccagactcttttctctatcagggattatgtgttctgaggcacccaaaacatctttctgtacaccaagttccttcatgaagacttccgggtcttctttccacttcacactcccttttatctcaagcttattctgccacaggcatttggttaagcaaatatgttgctcattggcaacttgtcccatacctgggccaggttatgaagaggattccaagagtgtcagtcatgtggtgcttgcttgggggagcccaagctgagctggggctgggtgagggatggacaagggggctccttcctctgctcatgcagtgaggtggaaagggcatggggttggggtgcaaggacctgggttcctctcttgcctcccctgtgtggtcttgggcaagttgtctaccctcctcatgcctcagtttccattacatgtagggtgaagaccacagagaaagttccacctagcacatgaaaaatactcagtaggtaatggctcccatttttgtgatgtatccaggtagaataatggcatttagcagaagtcagtttattcaagctcacctttgagtctatcttacacaaagcactggttaggtgagggatggcgatgagccccggagaattccacatgcttcccttctttagctttccagctagattgtaagctcctaactggatccttcaggatttggcacactctggtctgtgggccactgagacaggacatacatcttcttcatttctttctgtattcccagcaccaaacacgtggcatgtctctggtgggcatttggtagatggtgggcgaatgaatgaacaaacgagcattcagtaacctcttgctgatgaattgactaatactccacactggttacatttatattttgggcactgaatctctttgttttctggctctctcagggtatttaattttttctggaagctgaggttgagcctttcaggccacctttaccaggtcccaggctccaagtagactagacacccacccaggcctgggcagtggtagggagggtgtgacccaggcattggcctgcaaatttgccccagctccttcttgccaatgacttgtcacagggctcctgaagcctctcatgcctgactgcctcagaagaaagggtattttgtgagctctgtgggtgttaagtgttgaggagcagttcccaccagcagacagccttcacctgtgtttgataaaatgacaaattcatttttttcttctctaccccatccatctcctctttccttccctgtctgaaggggcctctgtcaggccagccaccagctatcgtgagaggagccaagttcctcattgccctgtgctgaaccgaactgcagcaagttggatagaggaggcagttttagcttgaacgcaaacatcctgtcggagaacagagtgattatagttttagctgcacacggggaaataacagcacagaggtgaatcatggcatctgtttactgctaattaacccctccgtgtacaccagtgttgtatgtgagccggcctgcggtctgaaccgcctcctataaggagggctcccttggcagccaaaaccagttggcccaaatgccttgataggcttcctgcttcacttgttgcccatgtggtctgattttagataaaagcattgcttttgggccagataagctttgagttctttaatgaagcactgtgtgtattggagagaggcacagagcacccagagctgaagctggtcagtcctggtcggccacagtttatggggctcctgggaggttttaaactctgtgctgcaactggggaaggttgtgggggaaggttgggtccagggagctactatttattgagggcttacaatatatcacattctgagctggccactttacatcttagctggtaaaattctcacagtgatcctgaaggacaagtgtggttcaggagctgagactcatagaggttaagaaatcacctggtggtggggttttggggagggccacacaggcatcccaagaggtagaagacaagctcagacatccaggaacttacagacttattgtgtgtgagatagttccataccatttgtaatttattcccaaaataaacagttattgagcatctattgcatgcctgtgctcagtgggggtggggggagtagggagagagaatccagaaaggagtcagctccagctttgtcttccataagcaaatggcttagaggggattgttcattttcactgttttgttttggggcaaggaggtgtgtcagggaggtgaggaggtagagtagagaatcatcctccaccgtgaagtgaagagaggaaggtacccccacattggaaatatgccttgaggaccagaaggaattgaccagtcttttgactttcattttttaaaattgaagtctaacatacatgtagggcatgcacagacataaggtgtacaggttggtacaatgtatgcgcctgtgcagccgcctgttcttggaggcaagagccctatgagttgcatgtggtcttcaggcagaatgaggagatgccgaccacaagcgctcctaggaattcagaggaaatggagcgcaatgaacccctccaaatctagtttccaccagaagggagaggaagatgaatattcatggatcttgatctctttttgcatcatttacattttgctttctccagatttgaggctccccacctgcccctgagttctgaagaataattgtttcatgcatcacatttttactgcattgggagaaaaagagggaaaaagaaaataaattgggagaagaaaagatgataggacttcttgactagttcagccagtttcgtgaccatgacctagaatgtgcctgggtctttggccatgtccgtgaaatgtgcacattatctttgggatttgcaggagcaaggtctggtgctgggctctgatgtcctgtggcctccatatgttcttgggaggatgtttttggatctggttaggtccatgtgttgggagcattgggagccaggagaaaccagaatgccaccaggattcccatctctttcttctctggactcctttagcttgcactgttgcatttcttaaatcatgtcactagtcaaatatatactttactgttttgtggaccttgatcttgccttgctgattagattatgaactcctctttggacttatgatcagagtgccttgtccttccctgatgtgctgtcccctgcgtacctagtcttgtctgagcacacagtacctcgccccatgaatgcttgctgtgtgcactgattttgcacacagcaagggtttttggtaaagttgtctgtggcttgccattacagggacataggattggatctagataaaccagtagaacagtttctgtatctagacatctgggtgaacactggccttggggaacagcagagaagcttggaaaaaaaaatgataataagtcacacttaatggagaactcgctatgtgccgggctgggtatgagggactttacgtagctgaatcagtgataagcttttgattgcatgtagcagaaatgctcacttcaatgggcttaacattaaagggactccattgactcatatagttggaaaggtggatgacttcagatgagccttgatccggtggctcaacgatgtctccatggacccagtttctttctgtcactctaatctgctctccttacagttggccttgtcctgaggctggtttgcctctgggttcacacatggctgctgcagctctggagggcacatgctgatctgctcaaccttgtcaggaaataaatcacctttgcaccagcattcctagcacaggttctgagagttgctgtaactgaactggctgaagccagggattattgtcagtatcctcagaaccttatggatctcaaatggaaaacaaggtctgcaaggaatggggaaggtggaagtttggaaaggagttagccaaagtcccctacacatgggtggttgcatttaatcctcatagcatccctgtgaaattggcatgattatcacccccatttacagacaaggaagcagaggcacagagaggccaagtaatttggctcagttcacatagctcatggcttaagccaggaattgagcctggacagttggactccagagctttgctctgctaaccactccatggcatttttcaataagtgcttttttgtttttttaattgagataaaattccttcttttaaagtgtacatacagttcggtagttttttagcttattcgcaaagttgtgtaaccatcattattatctacattttcatcaccccaaaaggaagtcctgtaccattaagcagtcactccctattccctctgctcccagtccctggctggtctactctgtgtgggctctctggatgtgcctgatctggacacttcatataagtggaatcacacaatatgtggccttttgtgtctggcttctctcacttagccaatgggagtttctgactaggatctactgtgtctgacctcaaggaatctccattcctatctttcccagcagaaaagagacagcaccgctggccgactctggaagaaagagattctgtgctagagagagagagagcctccacccttgtactccgcttaccttttggggcagcccgaggctgcggctcagtgagggcagctatggatatgcacagtgagggtcattctggattctccggcaccctctatgtgccaaggactgtctgaagccctgggaaactgcaacagaaagggctgggttgggtttcagtgtgtgtggtggggggtgcagataatcaacacttcagtaaatcaatgaatgagataatttacagtggcaccatgagaccactgaacaggggatgggattgtgtgtgttagaggggctgctttggtgggtagccagagaagcctctttcgaggaggagatggtcatatggcagaggcaggactgaggagaaagtgagggccacacaggatttgggccagaaagccgcaggcagaggagcagctggtgcagggtgggaacagggtggcctggcctttgggcgaattggggatggtgggtgactggccgccttgtttctgttttcatcgccttgttactgctttttctaaatggttcctcccacacagacatcttttacttgcagcttctgctatggaaggttttgtccactgctgacaggctgtggggagttccatccttgagtatgtttggggctttattttcagtctgtgtttttgaaacttgagccctgacttcctcttgttcctgacgcaggcctgagagtgccaattggctgtatttttttttttaaaatgaacacttattattaaaattttctctggataaataaaaattgtacttgtttattgtatacaacatgttgttttgaaatatgtatacattgtggaatggctgaattgagctaattatcgtatgcattatctcatatacctattttttgtggtgagaacactgaaaatctcttttcttagcagttttcaagaatacaatacattgttattaattgttatcaccatgatgtacagtaatagatgtcttgaatttattcctcctgtttaactgaaagtttgtactctttgaccagcattcctctcccatcccagcccctggtaaccactgttctgctttctgctcctatgagctcaactttttaagagtccacatataaattagatcacgtagtatttgtcttcctatccctggcttatttcacttaacatactgtcctctaggttcatccatgttgttggaaatggcaggatatccttcttttttaaaggctgaatagtgttccactgtgtacatgtaccacaatttctttatccatcatccgttggtgggcacttagataggttcgatttcttggctattgtgaataatgctgctgtgaacattggaatgcagacatctctttgacgtactgatttcatttcctttggatatataaccagtagtgagattgctggatcatatggtagttctatttttgatttttctgaggaacctccatactgttttccataatgactttatcaatttacagtcccaccaacagtgtaacagggttctcttttctttatacccacaccagcacttgctctctctctctctctttttttgcttatagccattttaacaggtgtgaggttataactcatcgtggctttgattgtgtagccctgatgattagtgatgttgagcacctttttatatacctgtgggccatttgtatgccttccttggaaaaatgtctatgcaacggttctttttgatagagatgttaaataaagcagttctgggcagagggagatcaatgcaagtgtctataacaggctgagagttgattcactggtgaacaggacaaccaaggtccctgccctcagaggtctgagcaattccatcatcagtgactagattgaacagataatcccctcttacacacgtatatgcacacttcagcctggagtgtgatgagagactatggactataatgcgtgtgtgtgtgggggtgcatcctctccttggccggggctcagggaaggcttccctgcagaaatgagacctacaggcccggcatggtgactcatgactgtaaccccagcactttcagaggtcaaggcgggtggatcgcttgagcccaggagtttgagaccagcctgggcaacatggcaaaactccatctctacgaaaaatacaaaaaattagccaggcgtggtggcacatccccgtagtcccagctactcttgaggctgagatgggatgattgcttgagcctgggaggtggaggttgcagtgaaccaagattgtatcattgcactcctacctgggcaacagagtgagaccctgtctccaaaaaaaagaaatgagatctacaggatgaagaggcattagccaggggtgggtgcagggggacgtgcagaggaatggtgtctttgaagactctgaggctggaacaaagcttcatggaaggaatgagagctggaaggacggggaggacttaggcagaaagcagcatagtccaggccacagggaccctaggaaagaggatggaggaaagaggatgacaatatgttacgggaaggcagggatgggtctcttttgtgaattacttaacccctaatggctagcagtgttgagcaggagaagggacctctcgagtggctgagtgtgggtgtcagttttcccttgctgctgtaacgaccacaaacatagtgccttaagataacacaaatatactcctacagttctgaaggcgagaagtcggaaatcagtttccctgggcttttaaagtcaaagcgtctgcagggctggttccttctggaggctctgaggggcaagtcgtttttcttgccttttgcagcttccagtagccacctgcatccccagtcttgtggctttctgctccgtatccaaagcacattgctccatctcagtttccatcatcacatctcttactttctcttctgtgtcaaatctccctctacctccctctttgaaggacctttgtgattgcatttagggcccacctggatgatccaggctaatctcttcatctcaaggtccttaattaaattatgtctgtagagtcccttgtgccagttaaggtcgcagtcacagattccagggatgaggacgtggacatcttctagggccatgattcagcccacctcagcatatagatgaatgccatttttatgggaatcagtgaggcatgctaagcaggaagcaatgccttttgcaagcagaggtaggaagatcggtctagtccgtcagctggcactggccaggctccactgtccattatcctcctcacctgccctaatctttcctttattgctcctaagtgataccacgtagcttcttcagtctcaaatcatcctactcagacccttttctgacattcagagccttccttatcccacagttctttctgtccttttcccttcctatctgataaatccttgtgagtagttgacaaaagagtgcctgaagatgtcagggcagaggctcacttctggtctgtctagttgggtgagtctgaacttgaggccccagggcttattggaggcaaactgagtcatggagagggagagtacagtaaggccactaccaagggctggctgcagagggtgcaagggttgcacgggttttggggttgttggcttccccagaggggttctttgtatggtgtcaaggtgcctgtgggcattaggtgactaaaaggactgaacacgataaactcttggtggctcttcctgctgcaggaagggaatactccaagttcccagaggagaccacccagtgatggagtgaagctgcatccttggctcccctcagctcaggaccctcagaaaggacttaggaagacgggcactgccagatacagacgtctttctggactctaggaaggggtgccttttttcttttctttaagagatagtctcactctgttgcccaggctagagtgcagtggcatggtcataacttactgcagccttgaactcctgagctcaagtgatcctcccacatcagcctcccaagtagctaggactacaggtgcgcactactgtgcccagctaattttttaattattttgtagagatggggtcttgaactcccagcctcaagcgatcgtcccctcttggcctcccaaagcactgggattacaggtgtgagccactgtgcctggccaaagatgcctttttgagggccatgaggggttgctgctctgggtctgggcatttctctggaggagctgcttgtacagcaatgattgtcccatccctccttttagtcccacaggtcagagtgggacttaggacagtgggacagtgggacccaaaacttaaagccagcctggtatttcagcagtattatctgttacctagagagaggctgatgcaggggtgtctgggaggctggagggctgcaccaagggtggatggcagagcctgagccatgggtctaggccgcagcactgccatgcggctgggaagatggtagtgtgtgggtatagtcatgggtgttgcggcttatctgcacctgcttgcgttcaggcagaagcagggtagcgtggcatggtgaggaccatggattcagttccagctcggctgctgatagctgcatgaccttggggaagttgcacatcctccataagtcctagttttctataacatgggcatccctgatgtagagcatttgtgcagttgtgtgtaaaggatgtggcagttaggaagcacctaccaagtgtgagccatttctgttgtcattgccatgtatcagccagcctgagggcctgcagggcctggcctgggatgtgggaaagctttccagaaagggagcaggagatggcgccctgtcacctccctcaactgggccagagtgtggggaggctgctcggggcttgctccttctgaaacacccctgacgactgtcccagcagaggagggaggctgccttggaagcctggctgcactgtgtagggagggtacccagcagagggctgggaggtctccaggcccctttgagcactgacagcccatcatctgacctctccaggaacccacgagaaagcatgagatgaacagacagacttggcttgaagctcacttcctagttgtgttactcctcagggcctcagttttgccgcctaaaagatgggaatcacgtcccacttgccgggtgctttgaagctcaggaaagatgaagcatctcttttagaggccctcagggctgcaggcaccatgccagctctttcctgtgttacctccttaaccctcttcaaggagggcatccgggacagtccctggcaactagcaagcacccaacacagggcccttcttaccaggtggcctctgaggacctttcagccatgtgcccctgggctgcggctgggcgcggtccttgggagggatgtccctctgtggttcctggaaagcccggcagctggctgctttgttctggccactgggtgtctgctgttaggactgcgggttttatggctgtttccttgtgctcaaccttttataggtgaccctgtgttttttggagccacacctgatgggggccaaggcctttgaaatgttccagagtctttatgggctgcagcggcatatggtgggtggcccaagctgcctgacaaggaaggggtgggggagggtggaggcagggaggccaggacctgcatttccaggtgagcctgagacctcagacggatgtgttgtttttctagttgcctacttaggtctactaatctttaggaaggaatgatagcctggtttatgggatatgacataagtttttctaaaagggacctgagatgaagaattaggcaactcttttttttggggggcgggggatggggttttgctctgttgtgcaggctggagtgcagtggtgcaatcatagctcactgtagcctccacctcctgagttcaagcgacataggtgcacaccaccatgcccagctaattttttttaattaagtaaattttttggggggtagaaatgaggtctcattctgttgcccaggctggtcttgaactgctggcctcaagtgatcctcctgcctcagcctcccaaagtactgggattatagaagtgagccactgtgcctggccaacaacttttaaaaactaaaataaatatcatgcctgctgattgttttttcttgagacttctttttttcttctctttcagtttctgttactatgtccctcactgtccttgacaaaagaggctttttatgcccactgtgggttttgcaggtgatagtttagtgtagaatggtagtgaaagccatgggcttagggtcagacaaagcttggtttgaatcctgtccctaccactgaactgacttgattgtcacctagactagaggagcaactcctagcattcacttcctcggggccaggacaagttggcatcctgctgcacacagggcaacctggagaatcaagagaaggctgccagcctcagatgccagtggctccctaggaaagacagtgttagttggtccccagtaatatctggcctttatcacacacctttatgtgtcaggcaccgttgtgagcaattcacattagtcctggaggcaggaaatgtcattaacctcatgttgcaggtaggggaactgaggttaagtaacttgtctaaggccacacatgtagcaagtggcagaggcaggatttgaatcaggcagcccaatgccagtgtctgcacttagaatcactgagagccatattgcctttctgagggctgttcttgatctgagagactagagtcctctgtcaagagctagtactgggcagccctgggggctgggttgtggggtgtgggctgtggaaggagtaagggaggtgctttctgctgtgtaatggggcaggtggttgggtgtgaactcgcctgacttatggccccagctgtttcctcttctaactcctcctcccagacgcctgccaggatgccagaggttagagggaggtgtgtccaatcatggactggatctgaggtccctctccttccctgcttatgacacaaatgctcagaccctgttctcctgaagggacacagaacctgtctccctgtttggattgcaagctccagactgcatccttgaagtgggacaacagagggaaatctatctcagcctcatgatccatggacgcatctcattcagtcctgggctccttgctggcccctggtgctgcagaaatccatggctgagggggtggagatgggtgggggcgaccgaaggaagctgtgcaagcctgactctgcaggaagtcctgcgaacgctggcattaaaaacaccattgcctgttgctttatttttagtggtacaaggagccctgagggcaccaggggggatgtgggaatcctattttttgctctgtcttgctaatggaacctctagcagtttttatgcctgatttgtttccctctgaagtctgtcatgcctgcagccccagactgtactcttccttgcacacagctcagaggaacatagacgatggtgtcagctgttggacttgcagccccacttcctgccagccccggcttccctgagaaggaagagggccgcctctcttgtttcatacccttccccattcttggcttggttacattgtgcttgtcaaataagcactcagctcccctctgagatgaatgcatattcccggaggtgtcccctggacatgctctgagaatgttcccatgcttgctttggttactcagaaccccgaaatccacgggagggatgagggtggttggctggcaggaggggctgctggagggctgaacaaatgcccgtgtggggtgctggtctcctatggtaggattgcaagggctgctaggtaggactgatatgtgcccagtgcccaggtgacaaatgacagacagcttgtggggcagggaagcacctcctagtgtgctacctccatattcttctacaccatcaaattttaaaaaccgagctttattgaggtatcactcacatgctataaaatttactcatttgcagtggtttttagtatatacagagagttgtgcaatcattgctattatttaattccagaacattttcatcaacctaaaagaaacaaaccccatacccatgagcagtcactccccacacccctccttccccagcctcagacgctactgaactgctgtctgtctgtacggatttgccccttgtggccattccatctaaatgtgctcatacaataggtggcctttctgagcccgtgtcatgctacaatagtgaacccctatcctattctatgacagacatgagagtgctcagaacctgaagagttggcattatcacaagcgcatccccgtctcccccaaaccaggcttcagtgccagggcagacatgggagacctgggaagcctgcccccagattttgctgtcaggcattggtgagttttgtgtccctcacaagtgggaatacattcaaaagacccctcccaccaactgggatggtgaaaagtataaaggacagtctcattctcagtgccatttagaatagggcagttttgatgaggagcaaggtgagtttcttaggtggtgtggctcttctcgaaatcaagggagctggagctggactcctgctatatcccttgctcagaactctgtactgcctggatctgatcattagcagagtctgcgccacctgctttggctcttggtccaaaaaatttgctgtatccttggcttagctactctgtgtccttgagggccaggaggttgccttgaagtccatgtggttcctggttgagtcactgacaaataaagtggccttggtgcttaccagggcccggggagaggagacaccatggtaatgacctcagacaataaacagaccattgggattggactgtggcctccagtgtcttgctgactcctgtcttggaaccaaatgcagaagctactttgtcctgcagctgatgggaataagctgccagcagatattttggtgcctagattatgaaaggagagtcaatatgtaatccacgggtataaaggtcatcacatggtccgagtctaaggcgatggtgttatttgtgcttgattggcggaatcttatgctgactgcttcttcacttcaccatttagagagtggacatcacacattagtcaatggcacacatttgggtttgaagataggttcaattgtatctccgtgttttcatgacatcttagagatcgtccgtccttttcactcatgaggctttggggtggagatagtaaaggtggctgatgtccctggatgtgagtgtgctagttcagcatgggacctcaggcagaaccttccccacgtgagccccagtgaccttctctgccgagaccctgcctcttagaggtgtgaagctcaaaggagatcatgtttctgaatacattttgcaaaggtggcaagggctgaccgtaaaagccaggcagtcagaccttcctgcctgtgaagggccaagatgaagtctctcttttgcttcgcagatgagaaaattgactttgctcagtgggagggatgtctgaccatctgaatctggggagaatcattaagtgcccattatgtggctgtcactgtgttaggcagtttgacaagcataccctggagcctgggagggggagtggtggagtggagtgagcttaaggactggaacagaagcccttggtgcatgcctgggcgctgtcacctactgactatgtgaccttgaacaaggtgtgtctgtgtatgtgtgtgtgtgcatgtgcgcatatgtgtgtgtgcatgtgtgtgtgtgtgtgtgtttgagatggagtttcgctctgtcacccaggctgcagtgcaatggcgtgacctcagctcaccgcaacctctcctcctgggttcaagcgattctcctgcctcagcctcctgagtagctgggattacaggcatgtgccaccaagcccggctaattttgtatttttagtagagatggggtttctccatgttggtcaggctggtctcaaactgccgacctcaggtgatccacctgccttggcatcccaaagttctggaattataggcataagccactgtgcccggcctctgtgtgtgtgttttgtagcaacttctctgtgtcctgatagccacaggggctgctgtgaggactaagtgacgaggtgtatgtcaggtgcttggaatgtcagtccatcccacctcctgctctccccactaggctgccacctcctcctcctccattaccttttgataggtctgattaccttcattttacagatgactctgggtcactcttcatcttttgtagaaatacctctgtagcaaatgtcatggggacattctcatctttggtagcagggagctcactgcctcctaggtatgttgttccattttggaatagcttcatgtgaatcttagcatgtgccaaggtggatgtggagtctttgcatcagaatcctgaactgctcatcctgaaaaaacgatgcgatcagcctgcttcccacagcgtatgctcagggtgacttcttgtgacatggagatggttggcagtgagctttctcttgtgacttcacacagggacaagtctgtggcattttaaggactagtgagagttcaggatggaggtgaaggagattggcccagagagctacagagttgaggagaggaggggtggcacacaggaggacggaccatcaggggctcaggctggcggctgaggtgggagtggtgtcattatcttccgggtcccaggccttgttcctcctgaccctgaaaggcagtattgggtagaggcatccccttgtttcgcagacctctattaaaacaaaggagaacaatcatgtaatgatctctctaattgctgaaatgacattcaatatgatccagtaggtgcttcatgatcacacatcgtcaactctgcgcagtgggaacttacttaatctgaagacagatagctactgaaatctctagcaaaccttattcctgatagatagacatgagatgcaatcccttcaggttaaaaagaagacaagaacgcccactatcacctctcttattcaaccttgcaccctaggtcagagccagcgcaataccacaagagaaaaccaatagagacataagtcttggaaaggaagagatgaaggcatcattattttctggtgcagccatcatctggctggaggaaatcgtagactccgaatctataaattattagaagcaacagagttgagccaggtggccaaaggtcagatattaaaatgcatattaaatgcatttttgatagaccaacagcaaataattggaaaacacaatagaggaaaccaaggctccgtgtggggcggggttttgcattatccagtgaggcatccacgctgctgattctctttctaatgatatttgtacagcatgataaagcagtatcgcatacatccagcccactggggcaaggcagatacctttattttgacttttagggaggaagaaccagaggctcagaggttagagcacccttgcccaagctgactcagtgactaggaggctgagctggggcctggccccctggaccaaccctcattcctttttgctgctttctacccaccccaccttcttcagaccttactttctccaccatttgtcttgttctgccagcttttcgttgtctgcctctagtaccagctgagctgggtgggagggagagtctgggagtgtttggatttgggttagcatctactctgtagtgtctttcatgagccacagcctgaccttcccaggacgcttgctgcactggatgcggggcagggatgggttcttctgagggaggagagagccaggcggttgtttggcgtggcctgggtccctctctctttgcgttgtctcccctcccctccacactgctcctctgagtctgacttacatctttgcttttttgttttatttaatgtgtgttcaaaagttataaaaatagcatatgttcacagcaactggtggaatcataatatggagaaaaagaaagtctttcttatttactgtttgatggctctcggatgccatgcactcctctcctgcagctttcctggccaagtgcttagggcctagggtggacccttccacttatttccccaggcccgggtcaagataggcaaacaggttttccattcattcagcaaaaatttgctggatatttactgtgtgctaggtgctggggatgccacagggaacaagacagggaaaaacccttgccctcttggagctgacagtccaggggattaaaatattttacagtgggccgggtgcagtggctcatgcctgtaatcccagcactttgggaggccaaggtgggcggatcacttgaggtcatgaattcaagaccagcctggccaacatggtgaaaccctgtctctactaaaaatacaaaaattagccaggtgtggtggcacacacctgtaatccagctactggggaggctgaggcaggagaatcacttgaacctgggaggcggaggttgcagtgaaccgagatcgcgccactgcactccagcctgggtggcaaagtgagactcagtctcaataaaaatgaaaacaaaacaaaacaaaaatatcttacagtgaagtgaatgcagccaatgataagtgctatggagaaaaataaaacaggataaagttcctccctgttttgtaattttaaaggagggatcagggtagaattcactgagaaggtcagttttgcacagagaccaaaaggaacttgggagaaagccatatggctttctggggaaggagcactgaggccaagggtaagtgcaaaggccctggggcaggatgtacctagaaatgtgtcctgtcaatgggacagagcagagcatgtgacaggaataaaggcaggaaatgaagtcacagaaggaggggaaggaattggaggagggcagattgggtagggccttgtgagccttgtatatggcttttcagttgtttaatgaaaatgggatcttactacattcttgtcccctgcctcttgcttttctttttaaatttcaatttattattatttattgatacataatattttacctatttatggggtatgtgtgatatttgttacatgtgtggaatgtataatgatcaagtcagggaatttggggtatccatcaccttgagtatttatcatttctatgtgttggggacatctgaaattctttctcttctagctactttgaaatatgcattagaaatatacaatacattgttgataactacgtttttcatcctgaacatctctcctgaggcaggagagatgagatctatatcttcctgtagatatagatctcattttaaaatataattacagaattttcacggtatagaggtaccataattttttcaatcattctcttttgatggactttcaggttgttgtcagggtatggtttctttctccactacatctcatatatgttgcctttcatgctggtgttgagagagcggaattcctaagtcaaaaggtgtatgtctatatagaatattaatagacactgttagatttcgctccagaaaggttgtcgccaatttctctgatataattctgttcctaagtctcagttgcctggctttgccctctagttgctaaatagctactctgcaaagaggggaagtcacacctataaaaagagatgtccctggaatccttcatcccgtgggaaggtgtgtggccttttggcatgtgctgctgggaacaatatcattcgctcttttttggagcttgtatttgatggctgtgacgtcaaaatagccaagaagatgaaaacacagctgttgctgtgttatttgcattatggctaattttccatatgtttaaaataagcacaacaccaaggaactgcatggaaacagattcacaccttgtcgaacattggattgtgttcctgtagcatcttaaggataatgcttccccatagcatcccttcttgtgcgcatgtaaatcctggtacaacctctgtgggtatgcgcttgattgccagttcccccaacccccaatctccggatgttatggagcaggatcgtgtaaactttggggtagacttttcatctgtttagtagccaaatgtatttgtgtgatttgtactgttggacatttaggccatgtcccatctgttgcacttcaaacaatgaataatcttgtgtatgagtctttttatgcatgtatgaggatttcttttggatagatttctagaagtggaattgctgaattgaaagggacttgccatttacaagttgatagatattatgaaattgatctctggagaggaaccagtgtccctgtccacagatagtacaagtgagtgccttttccctgcttcttcggcaattcgagatcttgccaccctttttgatttttgccagtctaatgggtgagacgtgatttattttgtatgagtaagggtgaacattacatgtttgggggccatttgttttatgtttgtgaattgtctttcatgtcctttgtcccccactttttttctagtggcttattagtctcttatgtggcccagcatggcctgtccacattaggagggcatttgatactgtgattggataaactaacctatctgggctgggggcagtggctcacgcctgtaatcccagcactttgggaggtcgaggcggatggatcacgaggtcaggagttcgagaccagcctggccaatatgggtcagaaacccagtctctactaaaaatataaaaattagccgggcatgatggcgcgcacctgtagtcccagctacttgggaggctgaggagaagaatcgcttgaacctgggaggcaaagattgcgccactgcactccagcctgggcaacagagtgagagtccatctcaaaaaacaaaacaaaacaaaaactagcctgtctggctagttagaggttgatccgcgcttctttattgtcaggagtgtaaatctattaataggtgtttgagaaaaggaagagcacctcagcaacaatctagatgggagctgcattttggtgtgtgctgtactgactgttccacaaacaggttgaacacagacgtcacagaactatggggccccgaagtccatgtgccggggtacatcttttatatggtctcatttttatcctattactgggtggaagaattatgaggaaacttgactgtttgctactaaaaccttttttttttttttttttttttttgagacagagtcttgctctgtaacccaggctggagtgcagtggcgtgatcttggctcactgcaacctccacttcccaggttcaagtgattctctggccgcagtctccccagtagctgggaatacaggcgcccaccaccatgcccggctaatttttggattttttagtagagatggggtttcactatattggccaggctagtctcgaactcctcacctcacgtgatctgcccgccttggcctcccaaagtgctgggattacgggcgtgagctactgcgcccgaccactaaaacctttttttccactcacttgaatttacaacctcattgtgagattttctaggcagctactccactgggacattttgctagtccaggtggcctagctgctgtagcaagcaaccctcaactccagccatgtaacacaatcaaagggtgtgtctgtggctctgccctttctaggtacccagaatcctcctctgggtcttcagctggcagaggagaaaaagagggagcaggatcgtgtgtgaaggctttatagagcagatactctgcccacattctgctggccagaacttgatcttccagtccatctaactggagggaggctgggaaaggccagccatacgccattgtcatcagtcctgaccaggtgcttggtgaaccatggtctcttagtgccctgtgggacttgtaagtttttgaagtgtcttctcaagtgtgatctcactccatcctcatagcactgacaaccctatgaggaagtaagatgagtgcttctaactcccagttcagaaccgtggagactgaggtctagggagataagtgtcgtgggcaagggtaggcacttaggtagggacacaaatggtagggagacggggtttgaacaaagagctctcatgctgactggccccatccgacaggacacaagagcacccactctgggtgtgcctgggtcaccctctgcatgtagtgggcatgggagaaaagggctgcttagcgaggggaaattggtggctggctggagtgcttcttctatcctagagtgtggcaagaaaggaagttgtctcttgccttttgcaaattgcaaccgaatggtgaggggtgacagtattgctactggtaggaaagcttggatggcagggacagaacggctgtaaacctggcacctctgggggagctgccccctcaccttgactttgaccattgtccctttcttttcactttcatgggacactagcgttgaaaaattggggcctttttcttcacactcccatttctctttatttaattattttaaaacatctgatgctgcagtgagatcagctgtgatacatcatctgttctattttgagctgcagggagacaaatggagaatactgctacctcccctcctggcgaggactgtgctcccaggagcccaatggatggaccgagccaaggcagctctgggcacaatttggatgctttcccctccaggggaatgcctgggtttccttattgtgcagatgccttgaactaacctggtcaaaaactagagagacaaaatcacagatggttgcacaggttgttggagtagcaaagacagcaccaagcagcagaaagaagatgaggcattgagtcctacgctcagggctgagcaccgtcactcctaattgaatggccactgaactttgtttcctcatctatgccaaagaaataacatttttcctaccactttcactgggttcttatgaggatcacacaagataatgtgtataaaaatgctttgtaaatggaaaagcactctgcaatttaagacattattatattaatagtaacaattaccatttccaattctggtgattcacttggggtaggagcccatagatctcatcactgctaccattactaccccacattgtacttcaaagctgcaattaccttgcacaatttcatttgatacattactgattatgcagtgttagaactggaaagcatcttgaggattaactaatccaactgtatcgctttatagatggtgacctggcgcctggaagggagagacttatttgaggtccctagaactcaggactgtgggctgtcattcctagggagtaggctgttttactttggattatggttccctgtcctttctgaagggctagacatgggaactttgggtgggacgttgatccttagtcattaggtggagtctcagcctgactcatgtctgcttactcacgtcaaccctgctctgagctccactgctcaaggttctgggcgcatgtggacagtgcttagaggagaagctcacatgctgagaagcttgggcacagggtcaaagagaggagaaagtaggaactaaagtggtttgctggcaagaaaaggagaccagggcaattccagaacaaagaaggtggaggtgctcctggtctcaaccttggtctttattggaccccactgcctttgtgcgctctctcttactgtccactccaggggctcaggctgccggggcacactcagtgggcacagctgcaggactgtgaggcctcctctaaagagaagactgaggggcctccagcattattgtaagtgttcaaagcgtggtcagaattcatctggatagaagaacaagcacaaacgggtaaacatcctggcaagactgagtttggcctcatgtcattcacagtgccactggttggcccctttcctgcctctgggtcttgcccaaatgtcatcttgcccacatgtcacttctctatttaaggatgccaactgcacctcacctcttatttggaccatctttcccaactggatttgccatcaaaatattatacagaaaatttgcaaattagtacagagaattcctgtctacctgttagccagtttcccgtaattgttcacatcttacatcactatagaatagaacaaggttcatgttggtctaaaactgcatgtcaaactttaagccttcctcaaatatcatcacttttcccactgatgctgtttttcttttccaggatccagtccagggtcccacattgcatgtacccaccatgtctccttagtgtgcttttgtgactcgtctttccttacctttcatgactttgacattggtgaagagtgctggttagttattttcataggcggtctgtatattttggtgtgtctgatgttttctaatggttaaagcatatgggtttttttttgttttatttatttattgctattgattgggtctctcctgccactggaatatctgctccctccgagcaaggattctcattggtctcgttcacttgtgtgcaggaacatctgtgtgtgcctcgcacccatgctcagtcaatatttgctgggcgaacgaatgagactgaactcccaggcattagtggagcatctgacctgacctgagagaaacgtggagaagctgggtcctggcagagccttgatgggcagttgggctggatgggcactaaagcctctttcagcattcaggttctgtgattttgtaacctgatggtggtatctgaactcaagctaattaaattccacaggtgtttgctgaggaagtacttgctgtggcatcctgggctgggcaaggtgggggattgatgggcatgtgcgatccaggctctgaaatgcaaccacattcccagggaagccaggagcacagggattgcatgtaaaacacaggtgtccagttagtggtttagaatctagactttggattagtggctcccaaaccacagcctgctttagaatcactaggaggacattattaaaacaccaattgctgggtcccaccctcagagtttctaagttgcttggcctgggtggggcctgagaacttccaacagcagttccagcaacttcccaggtggtgcttattgatgatgctggtctcgcaaccctatgttgagaagtattactctagatgttaagagaacacacaatttactgctaattagcaagagccaggagggcttcctggaggaggtggtcaggcttgagtagggtaggattttcagaggtgggtctgaggcttgaatctatacacagctggcttgctgccaccacatgcgatctgtggtgccttttgcctgcctttgccctgctggcacctggcctcactcgtggccttgtccaatcctcttggtacatgagtgatcttggccaggggagtctgagcccccagaggaggaggctgactaagccttagaatggagttgaccttggctggctgagatgaagtccctctgaggcctggacgtggcctgcgctgcacagcctgccttaatgtgtttatctgcctgggccttgctcgctgcctgctggcaccatatgaggtgttgctgttgagctccgtggctctatttctgttttctcgcctggcaccagcacagcagggcagatgaggtgtgtggccacccttggtttcttcctggctccaggttcttcttgaggtgggcatttggtcaggaagaacatttgagtctcgctagagtgtctggtacagaagcagctggacctttttcaggagggagaggttctgggaaggagggagaaataaatttagacttagcatctggcggtggtagtgagaggtgacagcgtgctggcagtcctcacagccctcgctcgctctgggcgcctcttctgcctgggctcccactttggcggcacttgaggagcccttcagaccgctgctgcactgtgggagcccctttctggggtggccaaggccggagccggctccctcagcttgcggggaggtgtggagggagaggcgcgggcgggaacaggggctgccagcggtgcttgcgggccagcgcgagttccgggtgggtgtgggctcagcgggcttagcacttgggccagcagctgctgtgctcaatttctcaccgggccttagctgccttcccgcagggcagggctcaggacctgcagcccgccatgcctgagcctccctgcccctccgtgggctcctgtgctgcccgagcctccccgaggagcgccgccccctgctccacggcgcccagtcccatcgaccacccaagggctgaggagtgcgggcgcacggcgcgggactggcaggcagctccacctgcggccccggtgcgggatccactgggtgaagccagctgggctcctgagtctggtggggacttggaaaacctttatgtctagctaagagattgtaaatacaccagtcggcactctgtatctagctcaaggtttgtaaacacaccaatcagcaccctgtgtctagctcagggtttgtgaatgcaccagtggacactctgtatctagctactctggtggggacttagagaacctttgtgtctagctcagggattgtgaacgcaccaatcagcaccctgtcaaaagagaccacttggctctctgtaaaatggaccaatcagcaagatgtgggtggggccagataagagaatgaaagcaggctgccgcagccagcagtggcaacccgggtccccttccacactgtggaagctttgttctttccctctttgcgataaatcctgctgctgctcactctttgggcccacgctgcctttatgagctgtaacaccgcgaaggtctgcagcttcactcctgcctgagccagcgagaccatgaacccaccagaaggaagaaactccgaacacatccgaacatcagaaggaacaaactccagacgcgccaccttaagagctgtaacactcaccgcgagggtctgcggcttcattcttgaagtcagaccaagaacccaccaattccggacacagtaggatgtacacacactttgtgcgtgtgtgtgtgtgtgttcagccttccaggatcatttaggaatttttattccttaattgacattcaaaacttgatggtagaggtgaggagaggcccagggagcttgggagaggccacgttgtttgtgcagttggaagactctgggcaggaaaggagcaccacatccaagtcagagaacacgggaacaagaagggccgtccatgtgcttctgattcagccccatcgttttaactgagacctagaaaactaagtacttgtcctactccagtgctgcctccccagtcatccatggccagactaaattactctatctttcctttgggctgcaaagtcgttttatttataacacacctctcttgttttataagtagccatgaaggggtttgttttacccactagattagggattggtacattacaggtcgaatccggcccactgcatgttttgtaaataaagttttattggaacacagatatgctcatttgttcgtgtattgtgcatggccacttttgtgctatgtcagaggtgagcatttgctacagagactaactggcctgcacagtctgaagtattcactatccggttcttcacagaaaatgtttgccagctcctcccctgggaggtgagctccctgagggcaggaacggcactccgtttatcttgctgcttcttgtttcttgctggtagtaggcactcaataaatgtatgttgaataggcttgaaatgcagtggattgatttgtcaaagatgagcgccagccacatggctgttctggcttccccaggtttcctcttgctgtttggccactttgtgctccagttttctctctacagaaagaagataatattatctatcttgctgagttcgttgatctgtggtgagggtagaacaggatattaaaatatcttactagaaccttgggcccagcttccggtcttcctgatggtttcaatccaggcctagcacgggacctctgtctaaaattctctgctctcatggccctgccattcctgaggcaccctttgcctccaggctaaagtaaacacctgtcattcatgatcctccttactttgatatgataaaatatcagggcccagactgcagtcccacggccctggactccagacctacctgtctgtcttgatctctcaatcctctagggcagccttctcctacatccagaattttctgcattctgtcccctacatgaatattgcacttgttcttgggaccctatccccctctccctcctaacttcctaccttgcccctttctgcctttctgctctcagcctcctgtctgcccttgcaggtctcttttatgtctgaccttgctggagtcctttgacctcggccaacaggagtgactgtctcatttgccacttaggcactgtcttaggttttaaatttttaatctttgtggctgcttgttaaaaatacagggacccaggcttcattcccatggaattagaatctccaaagatgtgatccaggcccctttgacttttaataagctcctaatgtggttgtgattatgatcaaagtttgaggaagactaacttaaaatagagtgctttgcagtattatttctctttctgtgggactctgcttatgtctccaaataaactataaacatcttgaaggcagatctgggccttattttcttttcagagtggcacatatatctgaagactggggccgtgagatgatctgtcggtgagataactccacctggggccctgcatctgataggcgctcagtaagtgtttgcttgttgatcaataaaagacatgaaagcacctgggaaagcaaaacagcctctgcaaagcagggcattattactgggagcagatctgatgtgtaccttccacagattccactgaaggtgtcctcagagcaccggacactcaggggcccgcagcccagacacagaaagtccgctctgctgagaaatgctcaccaagcagaatccctcacactctctagctttgttttctttgatctctctgagcttaggaggaaaggctcctgttccctccctcttggcttatcccaataatgcaaagccatagaagtgcaggctgctggggaaaagtttgtttggacacttaagaatgtagaaaagggtttagcttgtataaagagttttgctttctcattataatgcttggagagaagtgcaaatgtttcatctccgcctactgagttatactgcctgtttacataagcctatattcagtggcctgagaaaaggcttcttgccttcttcagggcgtgatggtgcaatcttggtgtagagtttccaagcagagatgatgctacggcctcacgtggtgggaaggctgtgtggcaggaagaataagttcaaactgtgctttgtttagaactgttgtgcaaagttgtttcttccatccaagtattaactgggccagaccctgcttagctgccaagatcagacaagatcaggtgtgtccagggtggtatggccgcagataccaagctatttctaacacaaggatgctctccttttattgagcagggagaagacagcacgtacagaccaaccatcctggttgtaaacttgtgtcctagtcagagctctttctagctggagtagaaaattcttaggctgtatgtaatggaaagagagtggagtccagcaataaaaacagatcaggtaaaaatagagctaggagtcaatagtgagggctgagttaggagagttctctgtacttccctagagatttccagccatctaagcatacgtgtgagttcttgctttgacaaataagtactccactggtatgcacatagaaacttctttcacctgtgggatcattattaacatgttttatgtggagggaaaaataaagattttagaacttctttcttccctcatgttttcactccattaatattaggcttaattattcaaatttattatattagagtcttattgcttaatttaaaaaattgaatggattattagctttttaataaacagtgacatttactgtctactaatgagggctcaaatcatgtaatttattgctgcatctctattttgttcatgaaatgaaacagaaattactacctacttgaaactggacttgttttctgcgctcctatgaaactgaacagtggagggttgctcgtgaaggatctgggacatgtttcatatggagcacaagaaaaggacgtcgaacatgcaacggtctgcatccaggtgctagaaccattttgtttttcccttcatcatccctagaaccaagagtgtgggtgggaatagctcagtagagtgaccatgtgatcctgtgttacaactgaagacaaaatctggcacagagtctctccagtgatgactatgaaactgactggtgccccatcagattcagaagtggagagtgttacatactgatttcagaaaaatgttagataaacattgggaccctttattatataccgggaacagaaaatgcatgttgataaaagtttgggatgttccatttcactctgatataaagtgtgcgtggtcagattggtttctatttttgataaaaatgaggttctggaaagccattctggctcatgggcttatgagaaaaaggttttggaaaggagttttggagtgctcccctacagaaatagcactgctttttaattgttctgtcgctagagccttggccccaaataacaatgcatgaatctcagtatttgtcttcaaggagctgtggtctgataggagcatatagtatacctatatggatgggtataactgaaggtggtgaggacctgtttttagatgcctgagaaatccaaaaacaagacagggaagttgttcgtctgggaatcatgaagcatgtaaacctaattaggggaggtggcatctgatctcatccttgcagaatacataatttttatacaaacaatgttgaagaggtgatgagaacagaaaagctgggtaaagtgcagagcatgttcaaggaagggttacaaacatttcttgagggcctgccatgtgcacagggcaccaatctagtgaaagcaatctgataagagcttggtacaaaaccaagtaatatagcttgtgcattaccttcactcctcttactccagtaatttttgagtaaaataaatgttgtctttaattatattaattcatacaactgcgacaacggcctggtgaaatcagtaccatgcttgtcctcatatgagagaagaggaaacagacattttaagttaagcgacttgcttcaggtcacccggctagtgcgttgtggggctgagactcaccccagccagtctgactgtgcaggagttgcagccatttgttcctctgttcacctcccccgatagtctgagtggcctgagagcaggcatgtgttttcgtcctcttggtactcctgtcatccagcaaactgcccagcatgtggtcagagttcagtatgccaagtacaaaagatctgctatggagattcttaagtgatcaatgggttttgagggacagcttggagaagggtagggaggttgttctggggtcagagaagaacgtgagcaaagggctagagtggctgagaggactgtgcagggagtgcatgctccagtgtcccttggccaggtgtgtgggcttcccatagggagctggaggtgatgctggaacagcgtgctgtggaaaccttaagtgcagccgagtgctgggttctctgtgagacttcttagggtctggaagactgggtcagacctcagcctcctaggtgatgtcagacagccaggccttctcccagctcactcttgagtgtctctgtcagagacagagtcagagactgaatggcgtatgggctggatttcagggagcatgttcttctttaaaaacatttatggaacaaggccaggcgtggtggcttatgcctgtaatcccagcactttgggaggctgaggcaggcagatcatgaagtcaagagatcgagaccaccctggctaacatggtgaaaccctccctgtctctactaaaaatacaaaaattagctgggcgtggtggcatgcacctgtagtcccagctactctggaggctgaggcaggagaattgcttgaacctgggaggcaggggttgcagtgagccgagattgcgccagtgcactccagcctggcaacagagcgagacttagtctcaaaacaaaaacaaaaacatttatggaacaacttaaatgtaccacattctgtggctataaagacaaataagggcttcccacaagtcttacgtatatgttggattgttggtgcttgttgctaggggaggacgagtgggtagtgaataccaaggccccgtctaaggtggttgggtggttataaagcactgtggactgacggtgtttctctgaccctaaggagctgactggcagggtacccaagtcctgctcactgcgtttttgtaactgagctaagaactgaagaaatcaacaaattgccaccaaatcagatccttagtaatacgtgataaagcatgacatatgaaagaggacacataatttaatcatcttaccccataaatccagccccctgcaatctgtctcttgtgtgaataagacttcaatttacagaaatggaaagttccttttttatctacatatggttatacctcctttcctacctggaaggcatttccttgtatttccttcctgagtagtgatcaggacttggggttgggcaccaaagcctttaggaagtggagttgggtgtgttggcctctcctgttgagtcaggactgaggctaggcctgaaaggtaggtgacaaggttgaagccccaaaccactaagaatcaacacccacttcctcttcatctgctctgccccaggccagggaggcaaccctgagacccaggagtaagctcaatcctgctttacttgcctggaaagtcaagtcactcatcagaggaggaagagtcagtttccctcaaggatgggctcttggtcatgaagctgactgctgttgtattactcagatttcagatcttagaaaattatagcagcatgggctttgaaggccaaatacatgatcatcacctccttttgagatgagactctcctggtatgacatccagtactcagagatgccatatgccttctggacttgtgtccctatatgagaaatattcaaccatgctctatcaagtctctatttgtcaggacctggattccagcagccatttgtgcccccgtccatctttctgtgaaactgggccagtgatgcattgacctcatttctgatgggcttcatagtgggactagttgtggtcagacctgcataagactgaccaggaagaagcccaacctgggagtccaaggagcagaagcaaggttcaggaccagggaagagcgggcagagctacaagggccaggctctgagcagtaagagattggcaagagcagccctgctgatgagcctgtcacagaggtaccatgataatcctggaccagtgagttatctttgtagcacaaagaaggttggaggcacagattgctgtggactgaagtaggaggggagggagatgctctcgtaatctcatgttgcctgagtcagctttgccttgctattggcggatggggctggtggcctgtcatgtgtgcagatgagtcagaggaagtgggccctccctggctggtggcttgccccatgccttggggcatagctaagcagttgcatgtctactaaacagtcttatctggaagcaaatatggaaccaaacacctgagcgtctgccaaggcctccaccaccaaggtcaagaagtcccccgaggggcatggctctgtgagctgcccttgtaggtgtcctggagaagcaggcacttccttgcagttggtcaagaagaggcaatacttcttgcttgtgttagggattttagagcagcggatttagggcatggcaaggttggggctacttccgggggaatgaacattttttaaaaattttactttaagttctgggatacaggtgcagaacatgcaggtttgttacataggtatacacgtgccatggtggtttgctgcacccatcaacccgtcatctaggttttaagccccgcttgcattaggtagggaatgagcatttcttcaggtccctaagcagagcttgaaaatgatgatatcaactttaatcactagcaattattaagctcctcttccacatatattaagttgtttatgcctcataataaccctgatgcaggcatcattatttctgttttacagaggaagaaacaaagatatgaagaggttaaataacttgccaaggccaatcagctagcgagcatcagagctaggattcaagcccaggcagaccagctccagagcctgagctagactcaatgtcagtgatgatgtcgttgaccttcggggacagattctgcttttgccctggtgggtctgggttgagatgcattgcatttgatcttgctggagaaatttccagtcttctcagccctgggaaaatatgtatattggaacctcagagctacaccctgagggtatgtctcctggtttgctgaatttttaaaaagaggttttactctatggccagctttcttgccaggagatcagagaccgatgacagctggcagaatcggcctctgttccagctgtctcctacccttcctaaaactcagatgctctttgaagctgtcttcctccattgaggagcatgtgcttcttcagtgacagccggagagtgggactgggctggcccctgtccttctaaggccaccacctgcagcactcctagtcaccgttccaaggtcactgtggaggaaacagaagtggccgagagaggaaaggtgcttctcaaggaggctgagagtggagggagtaaggcaactgagcacggcagttgggtgggcccaggccaccaactgtttgtcctgcctgagttaagagtccagaattggggctgggtgtggtggctcacgcctgtaatcccagcactttgggaggctgaggtgggtggatcactaggtcaggagatcgagaccatcctggctaacacggtgaaaccccatctctactaaaaatacaaaaaattaaacaggcgtggtggcgggcgcctgtagtcccagctactgaggctgaggcaggagaatgccgtgaacccgggaggcagaggttacagtgagccgagatcacgccactgcactctgcctgggtgacagagcgagactctgtctcaaaaaaaaaaaaagtgttgagaattgggtatcaaacagagcctggtgtctgtcctggctttggcttttagcagcctggaatcaaatagccacttacatgaaatttctaacactgtcatggatggcaggcaggtgctggagtcctactgcctgcattacccctgatgtcaccaccagtgagccgtgagacctgagtgagattggctatgtaacttgcagggtcctgtgcagaatgcgaatgtagggttcctataaaatgtatgaagaattttatgatggtgatagcagagcattaagccaagcatggattcttcccaggtgtggggacctgtatgatggcacaggttgtactctaagcctcagtttcctcatctgcaaagtggagaaaatagtatatttcccataggcttgttgtgaagtttaggaaagataataatgcatataaagtattgggccacatggtaagggcttgatggacaccagcatttatgagtgcagggtcagaaattcacagcttctttttgggtcattggcaaaagatcacggagagcaaaggtacctgcaacagtggtttagcttcaggaacaggtctggactttggtctctgcccttggctgctatggcttgggactctgacctcttttgcaaagcacagatggctcttctgcaggagcaagaggcccctcgtcacatgcacaggccacatggatccagagacacctacctcctagaagtgtgtgtgggatcctggggcaggctgaccctgccctgcatttcccaagtcatgggccaggaggaaggcagtagagattggagctgtttttgatgcgttcattttttatttgctgaaatatgttgaaagtcagttaccaatatcacaggatttcatccctagagattttagtttgcatttctgaaaataaagacatttcttttttttttttttttgagatggagtctccctctgttgtccaggctggagtgcagtggcgccatctcggctcactgcaagctccacctcctgggttcacaccattcttctgcctcagcctcccaagtagctgggactacaggcgcccgccaccacgcccggctaattttttgtatttttagtggagacggggtttcactatgttagccaagatggtctcgatctccagacctcgtgatctgcccgcctcggcctcccaaagtgctgggattacaggcatgagccacggtgctcggccagacatttcttatatatatactataatcttattgtagacattgaaggtttttgtttgttttctggatttattaaggatagcattttatggaaagttagctggatatgtgtggggagggaaagtgattagtattaatctggtttgctaggatgagaggctgttatccaaattcaaatttggcattcaattcaattgctgttcatggaagaaacatccggggacacctgcctcactgccccagtgggtcagatggaaatcactttctaggggagcttctgtgactcatttcctttgctgggatcccttctgtcttccacctaaaccatcacaagggcctcctgagggtctctcagcctctggaataacaccttcactggtccgttctttactggccaccagagaggcctcttgaagacgtaacccagatcttgtctttctttttcttaaaacctcccaaaacttccccattgcccacagcaggagtctaccggccacttctttttgtatagtccatgagctaaggatgggttctatctctttaaatggttgaaaaaaacaatagacacattatattttcgacatatgaacatgataagatattcagattcaaatatctataaataaagttttattgggaaagagccatctgcattcactgatgtatcttttatggctgctttcaagcttaccgtggcagagttgagtaattgtgacagattgacagcttgttacagagaagtttgcccacacctgagctgtaggataaaattcaggcttcttcgcacacacctgtggccatttgtcactgacacccctgcctccctgatccctcctgctttgataaccttccatgctcttagcaactcccagctgccggcagatgccctgcatgggccatttccacctctgtgctttgccccttctcttctctccatccttgctgcttccttggctagacatcactgactcatccttgaagaaatccccttctccaagaaggcttcctgacctccgctctttccctttcatcctgtttggtttagtggctccctccctgtttggacaggaaaaacagaagcccaacgactccgggaggttggcagctgggcgctcagcacagagaaaggaggcctggggccaaaatggctcactgagtcagcagacccagtgcctggtatatgccaggtgctctagatgtgaagagcacagatgcaggccctgcctctgtggggctcacatcccagtgggagatacagacagttaatgcacattttaacaaatatataggggatgagagtccatgtcttgggagtgccctggccagtggctaggaagtggtggcaggtggattttctagataaggaacccaggaaggcctctgaggaggtgacatctgagtcccgagagaggcagagcccttggcggctggatactctggagcgagagggaagatgagatctctttctttgtcctcttcaggctccaggaggtggtgagaggttgtcacttctcttcttccaggctcacagcaccagcagcctaagagtttacaccagactttcaagtcagagtcctcctccctcgttgggggctgcaggcttccctcagacccttctctggagggcatttgatccctaccacaggacttaactggaagcccctttttgagatctgtgagatgtctgggattttccggccaagaaggacttcagagataggcctgtcttcatctcaagaagcaaagctgaaacccagagcagttgagtcccttggccaccgggctgatcagcggcacagccgggaccagagttctggttttctgacccttagagcatgagatcactcatcttcttctgatttaattgggggatctcaggacagatcagccactagaattgggaggaggccattaaaggaaccccttgggtccacacaccactcaggagaaaggcccactggtgaggccaaactacttctttgaagaggcttctcttagtatcaccagtggtgtgttgctggaggtgtccagaggcactgtccgaagctgctggcctctaatcccaccagtttaatttagctccagtcctaggggagctttgctaattatagctagctggccatgctgggagctataaatagggcaggaggcacctgtttggtccttactggatgtttatcaaggtacctgcagaggatttggccactggactgggtgcaatgtgggcacagaaagcaccttgaactgtgctctttattcagtttaggcaccaaagccaatgtgaactgtggagggggcagggggatgtcaccagcacaacctggaaaccagactgtcagagttcaaattctggcttcaccaccaactagctgggagaccctagttacccaagctctttgtcctttagttttcccatctgcacaatggaaatctagatatttacaaagaaggctgttgtgaggatggaatgagtgtatgtttttatctatacataagttacgtatgtgtgtatatatgtgtatacacatgtaatttagagttgcctggtgtattaagtgcaattatattgcttgatgttatttattaccatatgaaatggcctgaggacgggaccatcttgcatagaaacctggatcttggaaggaggctgagtctcggtctctcccggtccttgatgaggcaagttaagtgcctcatctttaggcagttaaggcaagttaactgctttaactacatggcagttaagagagtgtgagccgggcgtggtggctcacgcctgcaatcccagcactttgggaggccgaggcgagtggatcacaaggtcaggagttcaagaccagcctggccaagatggtgaaacccccgtctctactaaaaatacaaaaaaattagccgggcatggtggtgggcgcctgtaatcccagccactcgggaggctgaggcagagaattgcttgaacccgggaggcagaggttgcagtgagccgaggaaaaaaaaaaaaagagagtgtgtaggctcgtcaacatggggtcagttactgctgttacctcctgtttggcatgctacttcacatctgtaattctccattcttctccattctttcctgttaaactgtggtgccatagcaatgagcatttcatgggatttcagtgagaattgaatgaaataatacttgcagagcatttcacacagtgcctaacacatggtgcatgggaaacagtgtaagccattgtcgtccttcctcctcccgttaaatgacttggacgggttaccagcatctcgaggcttgatatcctgtagctctctaggctagagaatgggaccagtggcttagagggcagaaggctagcagtcctgagacccctggcctgcagatgggaactggatcttcttcctttgcagtcttcttgttccagctgttagcgtcactccttttagaatcccatggtgagctttcttgcacggctgtgtgcttcctgtgtttctgtcattgtgccccagctgggtcccaagccctgaggaccatatgcagcatgtggtggacacttaggaagcacgtctccatggaggggacttaaatgtcacgtagtactgccccatcaagtgctgggagaggccgagagtccgcctgcttccaagatccctgaggttttgtttgttgtgacatagcaagaggagttaaaggatgggggattgtttcgtagggagaaagagaggctaagaggtagaggtggggacaggatacctgggtgcctttctgggagaggaagtctttttctttgtcctgtggctcagagcaagtctctcagagtggaggtttcaaggaggcagatctctgttagggaagggcgagttgcctggccctagacctgcttgaagtgggaagaatgtagatttggcagtcaggcctgctagtctagggccttgttcctcagacggtggttagaggatcagcagcacaggttccacccaaacctcctgggcatgaatctagatgcgtccggatgtgcacacagaagactgaggagtgctattctagaacagagcttctcaagccaggagccattctccccaatccatggctgagaagcctaaggctagaaacatgggccttgagcactggatctcaaagctctagtttcctctctggaccagtagcatcagcctcacctgggagcttgttggaaatggaaattcagaggcccaacccccaagtcagggactcccctctgggggtggggcccagggctctattttaactggccttccagtggctctgaggcaccagtgagatcgataaccaagagccagagcacctgcacgttggaaactcctggggagataaagcaaatgcttggaacaaatccgaatagcctctgggtatggcagggactctgggaacttcagatgctccccgggtgatcctaatgtgcagccaatattgcgaaccagcattttaggcctgtgaactaaatctcagcgttctcagctatcagttgggtagactaacctctgtttgcctgccagtgatgggaaggtgccttggggagcattaagacttagctccctgggttctggaaggcacaccagaaagtgggcttccatctgtccagaaaggtgcagccaagattcccgttttggaggaggcaggattggatgcccgccatggcctcaggtggaattgcaatgtggtggctgtttggtccaagtactaagtgctgtaaagacgataacctgctctggaaaaggaaatcgctagtgccttgagagaacagttcatgcattctcctcctcttgtgcttcccagcctctgccaccactgcttaattctggggcttacctttagtgaggtcatttgccctgtattcagggagctgatgctgtcagcactgtcctagcattggaatggtggggctgttggggagctggccggctcgttctgggcactggtggaggcaagaatgaggtttagagaaatatttacccaaagtaatccctttgctatgccactgcccatctcccaggaggctgggcaacaaacacagggttctggtcatcatttattgaggggacaagctttgcctcccaagggctaggaggaggcaggaacaaagggtggtggtacgatctgtggtcccagcccctgcagtggtcaggccctggggcctcctgaaagccatcagctcccactccaagcaggctgcatgtgcaaaatgaatactggattcaaaagcatcatgaagcaccagacatggaaagcattcatagtcttgtcttagaggcaaaattatatggcacttacagtgtgttgggtgcaccattcaaagtatgacctcatgtgatcctcacgaccattctatgagctaggagtcgtcatttctccaattttatgtgagcagttgctcttcagaggtctgtgatggtcagcctctgcatttcagaaataaggaactaaaggctcagagattagataaatgccctagtggtcataatgagtgagtggcagagaccttagaagtcaggtcccagtggctaaagtacatcctgaaaaagagagaatttaacgagacttctttttgattttcagtctgggatgattttaatacagaatgcctggattcagtaacaccagaaaaaacaatccacaggatgtttgtgtgaaaaagattcagaggcagtcatctagcacagtaaatcctaaattttttagaccacatcccacagttaaagcacacattgtgtgtgcaaagcatacattgtgtatatacatgtgtattatatctatgtgttatatatacatgtggatacattctgctagattttatatatatatatatatacacacgcatagatattaatatatatatcttatagaaagaaaagttcctgaaacaatggctgtccttaccacatgagatgcagcttgacataatcttttcattataaagaatgttacaaaggataggtctgggtacagtggctcatgcctgtaatcccagcacttttggaggccaagatgggtggatcgcttcaggccaggagttcgagaccagcctggccaacatggtgaaaccctgtctctactaaaaatacaaaaattagcctggcattggcacacgcatgtagtcctaactactcgggaggctgacgtgggagaatcacttgagcctgggaggcggaagttgcagtgagctgagattgtgtcactgcactccagcctgggtgacagagtgagaccctgtctcagaaaaaaaaaaaaaaaaagagtattataaaggatataaatgaacaggcaggtggacaggtatacagggtgagtctggaagggtcctgagtacagaagcttctgtccctgttgagcgaggtacagacctattctattctattctattctattctattctattctattctattctattctattctattctattctattctattctattctattccattccattccattccattccattccattccattttcttaaaaaataattgcttataacctgttacatagatttcctggtcaaccagggggttgaggcctgccatctgaaattgctgttgtagtccagctctcctgctgtagaggaggatgctgaggttttgcctcatattatgcttctcttagtcacaaatctgaggccaaatgcaactgtactgagggccacccctgcccagcctgcccctgctgttacacctgaggctttgttaagagtcttcctgggtcatgtctgacctatcctgtggttttatgcctacacatccccaccgcccatgcacacactacacatcatggctcccggggaggcccactgggctctctctggccatcaactgtttcatgctcctctcctcttctgatcactgttcttttctgccccttctgagaatcagagtgaagattttgagacttagtgggaaggacttttaagctgatggatttaaatataagatattttgagagatgacttatgtatccagttctacaccagctcattcccaacctgaagtcccccaaactctgaaaagtgagtgtttttacctaattcatggaggggctggtggtgagtggaagctgccctgaactgcgaggcagtttatggtcttcattcatccagcttagtctgaattgtcgtgtgtcattgaagaaatgttagtgtgtgtgactgtgatgtgcagcccaaacctcagagattcaccttaataatttcctaaaacccgaaacaattggaattctaaaacacatctggttttgaagattttgagtgaggaatcatagagctggagatatatttgcagtgtgtgcatgttattgatttttttttttttttgagacaagatctcactctgttgcccaggctggagcacagtggcatgatcatggctcactgcagccttgacctctcgagctcaagcgattatcctgcctcagcctcctgagtagctgggactataggcacatgccaccatgcccagctaatttatatatatatatatatatatatatatatatatggattttttttttttttggagcgacagagttttgccatgttgcccaggctgcctcgaacttctgggctcaagtgatccagacatatcagcctcccaaacgtattattgattaatcaatgaatttttttttgataagaagtagtgacagatgtgagaaagtacagtagactggttatcagaaggttggccattactggttataaaatgcacttttgagggcttttgtgaggacgaactgagtgatggctatgaagccttctggaaactacctggataagttgttgtgtgtggtctggtttctttttaaaattctgaattgtagtttctaatcctacactcattttcaacttttggcccacatcatgtgtgtatagggtaaaatatacctcttatgttgacatcctgtgatgaagaatgacccagaaagatacggagacagagagaaatgtctctacagtctttgtagattctttccccatccactctgctctgttctaatatttcccactttgttctaccttcttacagcatttcagatgctcctcaattggaactgctgactacacaggcgtgtgcgttttttcctcccttccattagccttataggtcattaaaaccttgttgctgctgctttccttttcctataaatacatctacatttcaaagttttgaaagcttattccttagaaggccctgggaactctgggctccaaagaccaaagaaaggtgtatctagctttaaattaggtacgggaaaaagcacagatctaggctctaagaaagacttcgctgtgtttacaataaatcagattgagggcgtgtcaggctttaagccaggattgaaagcatggcctttagaatacccagggagccagacctgggacccttgccaggtggggagttggaaatgagattcctgtctgaagctttcccctacaggagaaatatatccctaggggacagacaggtggtccagcagacatctgcaggggggcaaagggagaagacaggggcccttatctgttttggctttggcttgccaaaggatggaacaatgtttgctgtgagaatttgtaatcataagtctgccttcatgcaagtttggggtttgaatttgtactgcctgggtgacccaggagactccacgctgcaaaattaactggaggtagtttggggttggtcacaccagagttcctgtcagaatcaaatgcacattctctctggagggacatacttgtagctcaagccttgatggattcctgtaggtaaaacccagccattcaagcatgagctttcactctcaaaatccaaaacagatgaggaaaccagtcaccacgagtgaaagtcagcagaaacaacagacagaagaatcagattcccgagggtttcagatatagttccaatggaataggtaatgtattttaaatgtttgaaacaaatgaggaggaaacaatagactaatttttaaaatccatggagatttgaagaatacaaataggacttccagaaataaaaaatagaataactgaaattgaaggtcttcagcaattggcacacatttgtgtaagttatttttatgagcaacattaagatagcaattctcataaagatatatcaaagaaagtattttttttttttttgagacagagtctggctctgttgcccaggttctagtgcagtggcgcaatcctgtctcactgcagcctccacctcccaggctcgagtgatcctcctgcctcagcttccagagtagctggtaccataggcatgtgccaccacacctggctaattttttttttcccattcaaaagtaatttctttttttttattattattagactttaagttttagggtacatgtgcacaatgttcaggttagttacatatgtatacatgtgccatgctggtgcgctgcacccactaactcgtcatctagcattaggtatatctcccaatgctatccctcccccctccccctaccccacaacagtccccagagtgtgatgttccccttcctgtgtccatgtgttctcattgttcaattcccacctgtgagtgagaatatgcggtgtttggttttttgttcttgagatagtttactgagaatgatgatttccaatttcatccatgtccctacaaaggacatgaactcatgattttttatggctgcgtagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttctagttctagatccctgaggaatcgccacactgacttccgcaatggttgaactagtttacagtcccaccaacagtgtaaaagtgttcctatttctccacatcctctccagcacctgttgtttcctgactttttaatgattgccattcgaactggtgtgagatggtatctcattgtggttttgatttgcatttctctgatggccagtgatggtgagcattttttcgtgtgttttttggctgcataaatgtcttcttttgagaagtgtctgttcatgtcctttgcccactttttgatggggttgtttgtttttttcttgtaaatttgtttgagttcattgtagactctggatattagccctttgtcagatgagtaggttgtgaaaattttctcccattttgtaggttgcctgttcactctgatggtaatttcttttgctgtgcagaagctcttgagtttaattagatcccatctgtcaattttgacttttgttgctattgcttttggtgttttagacatgaagtccttgcccatgcctatgtcctgaatcgtaatgcctaggttttcttctacagtttttatggttttaggtctaacatttaagtctttaatccatcttgaattgatttttgtataaggtgtaaggaagggatccagtttcagctttctacatatggctagccagttttcccagcaccatttattaaatagggaatcgtttccccattgcttgtttttctcaggtttgtcaaagatcagatagttgtagatatgcagcgttatttctgagggctctgttctgttccattgatctatatctctgttttggtaacagtaccatgctgttttggttactgtagccttgtagtatagtttgaagtcaggtagtgtgatgcctccagctttgttcttttggcttaggattgacttggcaatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtatgagaatgcttgtgatttttgtacattgattttgtatcctgagactttgctgaacttgcttatcagcttaaggagattttgggctgagacaatggggttttctagatatacaatcatgtcatctgcaaacagggacaatttgacttcctctttttctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacgtcccatcagtacctaatttattgagagtttttagcatgaagggttgttgaattttgtcaaaggccttttctgcatctattgagataatcatgtggtttttgtctttggttctgtttatatgctggattacatttattgatttgcatatgtggaaccagccttgcatcccagggatgaagccgacttgatcatggtggataagctttttgatgtgctgctggattcggtttgccagtattttattgaggatttttgcatcaatgttcatcaaggatattggtctaaaattctctctttttgttgtgtctctgccaggctttggtatcaggatgatgctggcctcataaaatgagttagggaggattccctctttttctattgattggaatagtttcagaaggaatggtaccagttcctccttgtacctctggtagaattcggctgtgaatgcatctggtcttggactctttttcattggtaagctattgattattgccacaatttcagctcctgttattggtctattcagagattcaacttcttcctggtttagtcttgggagagtgtatgtgtcgaggaatttatccatttcttctagattttctagtttatttgcgtagagcacacctggctaatttttgtactttttgtagagacagggtttcaccatgttggccaggctagtgttggactcctgagctcaagcagtccacttgccttggcctcccaaagtgctgggattataggtgtgagccatagcacctggcccaagacagtttttttaaaaaaaataatttacagttttacagattaaatgtgtcataatgcattggaaagggtgccctagctcagacctgagtgtttcacttaatggctgtgtcaccttgggttacactgcagccccttggatcctcttgtgtaatttgactgcatggttttgctcccaaggttcaattagatagtttttgaaaggatctggatttccctttagcctttactttccttggttctggatactaaatagtttctcccttaggaagggtccatagtttctcgtttaattaaatcagctcctgagatgaacaaagggactgtgttcataaccgccggtagttcctccaggggctaggatttgctcaagagttacacacgcttatctggaagcccatggaggaggctggcggctaaaaggtaggctgccagccagaaggtcagtcttggactgcgaggctctggccgtgcctctccaccggggtggtgatggatggcggggttctgattttaagaggggcctgaatgtggttaacatggtgacagatatggatcttggttgggcacagcctgcaaattccaattaatctaatcccccgccttgggaaatctgaacattgcgttgagcttgaactctactgtagggctcagggcccaatctgttacatcgctctgcaggcatcccgtgctctgtctccttggtcagctcttctagaggacggtatctgccagggctcccccagggcctgagctccctgagcaagggagaggaggagagaggaactgggaaggtcttgagtagggaggttcaaggtaaaactagccacaggacaaaaacttcttccctccttttctccctccttccttcccttcccctctctctcttttcctcttttcatttccttcccaccttttccttcttttgctttttctccgtttctctctttcccttttttacttcccttattgtctctctgtagccgaagaatgcaagaccattttgttttcatgccacgaagtgagtacatgaacatttggaaagtaggtctcacctgggcttgcctccacccggaacaactctggacacatagtaagttttcagaagcagtcagatggaatcatcctggacattggtgcagcttctgaacctttcctggtgtgagtccaagttatggcaatggaattctacccaggaagggaagcagcaaacctgagtagtgcccacctttgcgggggaaatggcaggttcctccctctccagtgatgggggctcagcctgcagggaacctttcttcccagccagccttggaactcagtgctgtcaggcttgctgatgacatcactggccttccgtgggacagctgcagccagcatcaggacactccagaaatgccagcagtaattggaaacttcatgttcagatgctttccacagcattcacgcatggcgagaagtgcttctgccgagggacttttcaggtggtgccccgagcaggatccctgggagaccagggagatcagaagccaacttccatgtttcctggaccaaggatcctgggggatgggatggggggacattccccagagggctgcagctttctgtcaatgggatttcatttgggttggtctccagagagcccacagggtaaatttctaggcattaatttccaaagcctatttttgctattccacttaaagaatatttccatctttccttgcctatcactgctgcctgatcttgtttgtgcagtgggtgaatagaagagaaataagaggagagaaaaacatgaagattttaggggagagaatattccgtggaggcacagcaactgcctttgcatttctgatggtctgtaaagcgaggaggcactggcttgttctgtgtgtccctggtgagagcgttagggctgtggggaggtgcattcatgtggggatctcagggggatggggtgggaggctcacatttgacacctcctgtgggatagctgcagtgctagggtttgcgtctccagatgttagaggcagtaactgctagcctggtgcccatcacagataccagttactaaccacttatcttgtgccaagtactaagcactgcaccagatcaactcatttccttcttacaactaccctcttgggtgggaactatctctgacatcattttacaggtggaagagagtgactgggaagagcacagctgcttaaggtcacacagtgcgttggtggcagggcctgccctggaaccgaggctgcccatcaccaggctcctgtccccagctcttcagcaccaggatctgtttctcaatcatgtctgagctgtgtgttgaatgcactggtcctgtcttccacatttttttcctctaccttctttttatcatcatcttaactgtcatattaacatactaccttataaaagtgttgaaaagatagcaatttgggaaaatgtgctcagaagtaaaagctctctccctgtttccccgcccgctgctgcatcactgtgcttcctttaagggagtgcttaccatccgcgttgtcctctaaaacgggaatgggagggaatccctggaatccctggaatccctgagcctggagggattcacaaggggaaggtaaccacttgcaggaggccagtgctgggtgcaaggcaggaggactaggggacacttaaggtccagcctaaagaggacagtcactgagagtggcccttgatggggcttccactgggacagagatgggtgctcccagagggcgatttggccgagaggcagtggcttcccttctcaccgtctgcctgactcattgcccttgcctcctggccactctgccagctttccttcaccccctgctgcatatcctgcatgcagctgcccaattaagctccccaaatactgatttcatgatgtcactgactcctctgaactccttttacctccctttgtgatcagaagcctgaacttctgaactcctctactcctaagccaaagagtccgccctctgaccccagcttgtcttccctctgctatctgggagtctctcctcttttccacttagttgagttcctggttagttcaaggctccattcattctttctttcacctagatgccaggaggaagctgcgaaggctgagacataaagacatgtcacctgccctcaaagagcgcttggtcttgggaaggggcatgcatgaaatcaccttttttacatttaaatttaaatttatttttgagacagagtcttgctctgttgcccaggctggagtacagtggtgtgatcttggttcacttcaatctttgcctcccaggttcaagtgattcttctgtctcagcctccagagtagttgggattacaggcatgtgccacctgtaaaaaaaatacctggctaatttttgtatttttagtagagatggggtttcaccatattgcccaggctggtcttgaactcctgacctcaagtgatctgtccgcctcggcctcccaaagtgctcgtgttacaggcatgagccaccatgcctggccatgaaatcacctttgatcagcgtggtgagagccacttcaggctgcatacaaagccttcctcttgcaggaagcctttattgattgcactgtcactgtgaattcactcttctctggaggctggtgaatcctcatctctgttcttctctttttgttccttgttttctgcccggtataattcactttcttttattgccaatatctcttggactttagccccaaggaacataccacactgcctggcactgtgccatgtgcctaataataaggaggtacatttatattgagctctgattctgaagcctgttcacatctgtgattccccttactttgcataacagctctctgggacaggtgggacaaatgtgataagccccagtctgcagagcaagagacgacttgcttatgggcacacagttcataagtggcagagccgggaccagggactggagtcttgccgtgggtgtgctacgcggccccacagaaggatggatgcatggagtcccattttgtggactcccccctgggcctgcaatgtgtagggatgtgttaggggaggatgagagggcaagagggggatctgtggctagaattccggaggttcgttggaaccagggaggtacatggggtgacttgaaccccaaatcttttcatctaggcatgacactccctttttcctctatggagactgggaatagcaggatggagggagggtagaaggagtagaggagtcagtgttggggctagggctgggagggacggggtagaagagagcaagttctggggacagagggcagtcaggagacctgtcagttctctctgggtagcctggactctcgagaggactgaaatgcatcaaaggatgggtaatgaaaaaatggtgatgaggacgggttgccttatcacccagaagggaggaaaagcttcaggcccaaccatcctgcttaaacatttgagaattctatgcggttcttttaagtatttagaggtactggggacaatgtgtccagaaagtggaatcccagctccttctcaccccggctattgatttttggccttgcaattactgcagaggtgctgcctctgtgaacactgttagtgctagttagaaagcttgagcttttgaagcttagctgtttgagctacctacgggtttggaaaaaaaaagaatcttaccatgtgtttctttagcctgggcatgaatcaaaaatagttgaactttttttttttttgctcaagtctcaagtttaaaaataaaaaagtcacctttgggctgagatcaagaatggaaaatttcagggcatagcgtaattttttccccatctgttctgggcaagggatgataaagcattctgttggaagattgtgtgtaagcatcaaccatgagtctcactactttattgcgttgcaatgtctactttgttaagatgtcttgaaagaaagacttcttccatcctcctggcacaactgaatgtgcttggtatggggagacgtgtctaactgaatctaagcaactaattggaataggcaaaggaggaagtgatgaaagtgaagctgcagtttctgcaaaggtggctttattgtataaggtgcaggttagtaccccaaatgatcaattactaaagttctggattgggcagtgacaagtgtctagagggaatgctgggccgagggaattgcattgtcatgtgagaataaggctggggccacctttacattttcattaaaaaaagatctggacagtacttgactgtggtagtagactttgtaaaggttattatggttacagctttgtttgcttgagatcctctatttttatagttcaatattattaaggtatgaagaaactgttttatggatgtcaattttactgtttctgacaacagcttgcgaggaagtatacatttgtgcaacagaccgctttggatgttaattctaaatttagaagccgccttcaatgggtgtggaaatcagttacacaaaattcaggtgcttactaaaaaaaatctgaatatccatgaagcttgtatggtccctggtggaactttgagcagctgagcctctctgaagatcctgaggttgtcagggtgtggcacagcagctgggggctgggccccgtgcatgcacatcagcatctgtgtattgaatataatcagcacagatagggaagaaacaaaccaccaccaccaaacaccctaagtaccaatctgggcatctgggcaccctggattttcattttgactctgtcatttactagttctctgaccttgggcaccatgctttgcatagcagccttggtttcctcattggtaaaatgaggctgttgaattctatatggctcaagagttctttccagccccgaaacatgcaaaaattcagtttcgactaagagctttagcactctcttatcttggctgtttgcagtggccaaaattgataacatattggaaaacttccctgctgattaaaatagacattgccctaagtgctgtgagtgtccctgttaccttatcccttctctgaaaccctctgggtttccccttgaagcagcccctaaaatggctcagtttccagcatagcaggaggtctccagcctagccaatggtgccccttgtgaaggtcatggacctgccttacccattgttaaatgttttccatccctctggtgtacgtggagagcttctgggtggagtggacacaaatgatttaactttcccgagtctctgcttctgcgccagaaagtggaaggaatcataaccagtgtagtggaggtaattaggagggtccaaagcttggaccatctgggttcaaaccctggccccaccacttagtatctatgtgagtgtgggcatgtcaggtagcctttcttacctcaattcataatccgcaaagtggggatgagaatagcaccaactgtatcaagctgatgatgagatcaaataacacacaaaattcttagaatagaataagcactgtagaagtgatagctctgtgtatgtcattaatacattcactggtatcactgaactttattttatatcaagtgagataactactataccatccagggagataatgtgtgtgaagcccatagcacaatgcttgacaaatagttttcagggaatgttagcttctatctaagcaggtcccattggaaaaaaaaaaagttgtatttttatatagttctagttagtttctcatctgtgatctatgctatttttaattgaaaaaaaaaaagtgtttccatacattgtcaggaggagccgttcccctgtcccagcctctcacaaagcacaccctcactccctcatttttccagtagtcccagggctagaccacctgtagagacaggaagcctgcctaaagagcagaagcatctgctcagaaagatctagttgtttgctggagcctcagcttgaagaaggctccaagtttattgtaaagtcccagccacacagtttgcttgagactttataaagagagaatgagatgtagaggctgggcccaaacccactaccaggctgtgggaatgggggatggggtgcttggctggcatctcttctcagggcctcctggtcagcctcaggagatctagtgctaagggttactctgctggggaaaatctcaatggcactagagaccacttgagcacagctcttaggaactgaggagccagctacttagcatcccagaatcccaatgcccatggccagagccagagctgcttagaagaaaagcaaagtccgcaggctgcatggactgagaaccacctcacctggctgcacattctctgagtggccttgaccatgctgttctctgagcctcagtttcctcatcaatgatagagtggagttagctagatcaggggctttcaaaagctttttcccctgaaacccagaatgagaaataccttttctttctcaacccaatacttatgttcatgtatgtaattaaacaaaagttccatgcagcaacccttttaatatgcagtactctgttttctgtgctgttgtttcagttgaaaaatgctgattgtgaatgattcagttgattctgtgacctgctgatgggtcataacctgcagggtttttgttttattttgttttgtttttgttgacagagtctcgcactgtcacccaggctggagtgcagtagcgtgatcttggctcactgcagcctccacctccagggttcaagtaattctcctgcctcagcctcctgagtagctgagattacaggcacccgccaccacgcctggctgattttttttttttgtatttttagtagagacagggtttcaccatgttggtcaggctgatcttaaactcctgacctcgtgatccacctgcttcagcctcccaaagtgctgggattacaggtgtgagccaccatgcctggccataacctgcagttttaaacatatcgggctgaatatagttgagggcgcttaaatgctatgatgctgtgattcagctgggccaggaatatagagaacagtggcaccctactctgtgttgggccagagattgctgaaatgtctagcatattagatcaaccagatttttagttctaaaggtgaaaccagaagcatttttttttcctctcaaaaacacacatagactcagaggtatggatacaatacctgaagggctatagttctttttccaggattgtccctctcagcaggaatggaggatccctagctagagaggagagctgggggtgacaccttcttgcccagtggaggacagctggtggtgtggcctcaacaggttcttaggaaggtgagttccttagcctttctactagtgaggtgtttgggttaaggtgcagcaccattgactgggcccgtgtggggaggatattcaaagcatttcacaattacacagctgcctgggcaccgacagagtcctagagaagtgtcgactgtgccaggtccaacccttcagtcgctggatcatggggaggcatggagtcccattgtagaggctgggtggtggtagtaggcatgcaggaattcagggaagctgctacttaccaccatgtaaaaaggatttcaatattttcaccctggtagggatgcaccagtgtgtgcttctcagcctcagtcctggacgtatgccccattgccctaaggttgtcccaaagaggccaccattagacctcaccttttatggacaggtgggagatgtctgaacgcaaccacatgttgcccggtgacaggggctgggctgaccaggacacggagagtgacttgccttctggggctgagccagtcactcatactcccagcgtagccctggagcttcactgcaactgctatgttacaggaagttgtaccagcagctctacactaaggtgtatagtcggtgaccactttaaagaaagactcattagaaagaggcattgtttggggaggccaacaggccagctgttggggaccatgccagaggtactgtgtcaaggtacctggcttgatgcttacttcccattgtctgtttcttgagtttattttgcgccatctgccttcttccacctgatttggaattccaggactgctgtgtaggcttctcttcagatgagatgcagcagtgttctcaactggcaggggcagctttcttgggggcagggactgggcatctgtgttatctatcctgggcccatctgtttctttccccttgacacccaccacaggggtctgtgtacaagagggttggttgataccagttttaatgagggaacctatcttcttggaaccatccagaagctgtggtctttttccctggaacaccccacccccgacatcccagtgctggattcaagctggtgaaccacaggtcaaaattttcagttgctgtcttccagggccttggttgttccattgtcccctctccctgtaccaggatcatcgtgatccaatggatttgatggagttgctacacccagcttggcgtgcaggggtgtttggcacatccctgcctgtggaattctacgctctaagggagatgctgccagggtattacctgattcacgaggcatgtcctaccatctgtgttatattttttttaagatcagaattatgaatatttcaggagtcatctgggatctgaagaagcaagaacccactttctgagtcttttccttaaccattcatagggggtaagaaatgtcacaggtttgttgtgaaggtcaaatgaaagagaacttgagaaaatttgcaaatccttcagttcaaggtgaaagaaggtaatttattattaattcatattgttattatgtagcatttcttagaatatgtataccaaatgccttttttgactggtgcaatctttctataattccattctgggatgttagcttatttgcttagagaatggtgtaaagaggggagcccgaggccggcagatcacctgaggtcaggagttcaagactagcctggctaacatggtgaaaccctgtctctactaaaaatacaaaaattagccaggtatggtggcgggcacctgtaatcctggctactagggaggctgaggcagaattgcttgaacccaggaggcggaggttgcattgagctgagatcatgccattgcattccactctagcctgggtgacaagaacgaaattccatgcaaaaaaaaaaaaaaaaaatcacttcctgggcagtctgaatttcttaacctgccccagagagcttaaaaactttagaaaatgtggaggatccactttttaaaaaaatatatatatcctctgttcatttctggaagccctaaggaggatgagagttacattctctgtcactgcccaagattctctcatgaactgtataaacagtgttgaactacatgcttgtctcataaacccagttgggcaaatattataggcctatttctgtcacctctggctggtggagtgtttgtatttgtccacacatcctttatgcccagggcacgccctggataggagaagcttgtgccctcccagatggaaaatgcccataactcatcagcccaacattggactgctaattgtaggcctggattcatagtgttcttgaaagcttcagggtgagattaaactgccttttgacagtgattgacagctttcaagattgaaataatgagcctggagcccccattccctgcaaaccactctggagttaatttccttgcattcttcctaccttccagaaacctgactcctgtgcagctctgtgttcaatggatgtcacatctatcttttgctcttttgccaaaattaattgccagcattatccaagggagtctcaaaccaatcaggtcttgcagctagaggatcatcaatataatacatgctctattgcctcagtgactttcagtctctgccctggcaggggtcctaggagattggtttgaggcattgcagtttgattgtgcttgtgattgatgggccggaggctggagctgaggaaatgccccaaggattacattttcttagggtgtttttgactcacaggtgtgcaccaccatggaatgactattgtgtgcggagggaagatggttccctggagttgggcatcaggcacttggttgggatgctcatgacccagggatccacgctcatcttgatcctcagttctgggtgtgtctgggccatatttccagagtcctggcttccaccagatgcagcataatcacggttttgaaagcataaagagtccttattgtactgtatcctggtcttcatcatcatcacttccatagactgcactttacagggcatagaattccctttttttttttttttttttttttttgagatagtcccactctgttgtccaggctggagtgcagtggtgtgatctcggcttaccacaacctctgcctaccaggctcaagcaattctcctgcctcagcctcccgagtaactaggattacaggcacatgctactatgcctggctagtttttgtattttcagcagagatggggtttcaccatgttggccaggctggtctcgaactcctaaactcaaatgatccacctgcctcggcctcccaaagtgctgggattacagcatgagccaccgcgcctgaccctgaattgacttttaattcctcgcaattactttgagaactataataccatttttaaaggtgaagacacaggctcagagagattgggtaatttgcccatggttcctctgatggtaactggcagaaaggggaactgaccggaaatccaagcccaagctatttctctctgtccacaccatatgtcagctgtgtcgattcttatgccatcctctttgaaaagaactcagagtgcttttgaaaacccacattttgcaattgctgctttatagagtgtcaatgtttgtctaagttaattctcaggtagtgacgatcaaagatgtaacagttcatccagggtttacctagttaattccagcacagaaccagaaacaagatttctggcctctctagcactaacctctccagatgccttccatgaggcatatgtgtgtgctagaggcatggaggagctaagtttgggtctctgtactgttcccttctcatctgtttaacctccaaagtattgtaccatgttctctgtgtccagtggaaaatgatgtttttacattgcatcatctgtcattcttaaccccagagtggggctggagtgttggaacacttcagcacaggactctgtttaaagctgtgagaagctctttttgtttttctaagtcggctgaactagtaaaacagttttacaactgtgttttcaagttctgttcagaaagacaagcttgaaaaaataggtgatgctgaagtgtcattttagtaaattttttttccctgttagaagagaggttggctcttccttgattctaatctttaggttatttctccaagagctacctttctgttttttttctttctgccccatgaggtcttcagtcctggatactctcatcctataatagccagaaatgacccttgatccatggagtttgacttgggctgaaatcaagtttcaagaaataccacagggccttgtgactttgtcacatgtcaccctggcctgtgagggggccgtctgactcccgccctgaagtgtatcagtcacatgcccttgtttgtctgccccctccccagctccccagcccacctccctatgtcagtgtcctctttcttaaatctgcactggactggggaagttcttcatctgatgcgttttcctgtggtgtgcgtgcgtgtgtgtatgtggtaagagtgaagagatgatcaaggaagattgaggcagctcgaatttcattatgaacggttcttctgagaagagaagtcactttcatattatgagaaaagttaggaagaggtcaatgccaacctgcacccctctgtgattggctatccccttcacctgccttgtgtaatgttgccccctttccctaagacccccaggagggcctagtttgagaaaatgggccgtaatggttgactgtgcccaagagatcaggctcttccatgtgcggaggagtctttggagatggcaccgtttccaggaacaggaaggccttggaaagtttgtgggctccttgggcagaggcaaagtttcttttggactcttccttagtcttcctcatttccaaatttcaaaagtgttttctctttctctttctttcttttcttttctttctttctttttttttttttttttttttgagatggagtattactcttgtcacccagactggagtgcagtggtgcaatctcggctcactgcaacctctgcgtcccaggttcaagtgattctcctgccttagcctcctgagtagctgggattataggtgcacactagcacgctcagctaatttttgtattttagtagagaggaggttttaccatgttggccaggctggtcttaaaactcctgacctcaagtgagctgcctgccttgttctcccaaagtgctgggattataggtgtgagccaccacacccagcccaaaagtaatttctttggactcttccttacctcatcagagaggagctgctactttgttgccacagactgtcctcagagagcctttgatcctgtctctgctgttccctgtgctgcaacctgggctttcagcaggcgaaagacacagcagacctgcccatagctgtgggcagtccggcttggcttgttaccaagagatttactcagcttgctttgaagagcttgtgtcgcccagtgaggaaccctgtgggcttctccttccactctgtgttgccagtggcctacatctgagctgcccatcgtagccacagtatcatctgttggaaccttaaaaaaaaaaaaagtcgatccctgctcaagacctacaaaactggaatatccaggagtggaatatcaaatctgtgttattgaacccagatccacagggagttctgatgctcttctaggttttagaaccatgtctgtttactcatttactagccaatggggaagctgggaggaggggcaagatgacacttgggtggggccttctgtccttttggttaccttgagcatagctcctggccttcctggtgaaacagcctgctgctgaccttgaacctggggtgggttcagcaggaccctctagtccctgatggggcatcccctgggagtaggcttgaagtagaagcagctttctgggtgtgggatgcccctgagacatagcaggtgggctcactgctgagtaactagaggtgcccaggccctgactgggtgtgcattatggaggaacagcttggtgcactgcctgcagggttgcctggtgactgcccagcaggagggaggcgagggcacttcttgggctggtgctcactgctgacccagtggagggaacattcatctcactagaggagtgtcaacggcgcctggttcctgccttctcagctcccaagtgcccctttccttgctgcagcaggagaggagacttggccaatgggggaagagtcatttatccatgagctccaattcaggaacatttgaaatattgacaggctgccttttaaaacatttacaacaaaaatagttttatggagtcccacgggggaaaaaaaagaagaaaaagttatatttctgatttcactcaataaaggaatgatactgagaatatcagctttgttatttcatcactaaaatgttaatgtctgtgctgtttgggaagttgcaatgcagaggcagctttctccccgcctccccaccccgccacccggcgtttttttgttttgttttgttttttgtttttttgagacagggtcttgctctggggtacagtggtgcaatctcagctcactgcaacctccacctcctgggttcaagcgattctcatgccccagcctccccagtagctgggactacaggtgtgcaccaccatgcctggctaatttttgtatttttagtggagacagggtttcaccatgttggccaggctggtcttcaactcctggcctcaagtgatcggcctgcctcagcctcccaaagtgctgagattacaggcgtgagccactgcgcctggctaacctttttggattcttaaatgtgttcatgggctgcatcaggaagccaggccaccgctggtccctaggtctggggtgttcacaagaagagaagatcataaacatcatgtcaaaggcaggaaaaacaaaactctgccctctgtggtattaagtcccagtacttgaaattccaaatgtccaaaggggagcagagagcagcacacacatgtatcagttgcttgtccacctggtagttgagtgccttcactgggtatgtgtggtagctacagcctagacagtactgctctatgctgggcactgtgctaagtgcttgccctatattaacccttttagtcttccctacatccctgaaatgtgtttatgcacttcttgttcctgttttcatatgaggaagcagacccagaggatgaaataatcttatcgaggtcacacagctgggaaatggagaaattaagattcaaaccagacaggcatcctccagagctaatggtttaatccaggcactgagttgccttttcccaaagtagaggataagtcagtcaggcagccacggccctcagggtacctccagcacacctcatgctgggcccctttgtagtggctgggctctccccttgaagagttttctccatctcttggtctacaatctagcttcccagccttctgcaaccaaatcctttccttactggtcagaaatgcctggaaattgcagattagttcagggagatttttcccaccatgggtcagagagatttttcccaccatggctcagagaggtctgagcctctctgtcactgacatttgacctcatcctcgtcacttctggccttccagtggggctggtctgttctaaccatctgtaagcttagaactgtacggtcccctttgtggaaatctgcttccaagagtggtccctggaaggagaaggtgacttctacatctgtcctctggttgatggcttgaatagatgtgctggccaggttggattggaaggtctcagtcttcccagcaagctccacacacaccatgcttaggggaaagaggctcttccttgatggctccaggctgcagcatcagtcgaatcctagctagaattttgaagcatcattgtgctcatcagaaatatttaattaaggctgcatattaacagtgtgtttttccaggccctaggcaggaccagtttagttggaaacggttcctggccacatggagagcagtgcctcagattggaggtggaaagagcatcaactgtggggcacagggatttgggatccagtctgtttctgctcttctttctataggtctgagttttctcatcagtaaaatgaagccattagaaagttggagcttttgagatttttgctgggtatacatttgtccagaagtatcttcccaccatggctcagggggtctgtgcctctgtctgtgacatatgatgaatttttaaaattggatacacagaattctctagggagagagaagaatgaaggtaaatgagcccttcctctgtccttcccctgtacatataagagcataatttaaagtcacccactttaagtacaatatttacttaaacttgcataggtttttcctgtcactccatgatacatgttttatttaatataaaaatagtggtagctgggtgtggtggcgtgttcctgtagttccagctactcgggaggatgaggtgggaggatcacttgagcctaggagtttgagagcaacctgggcaacatagcaagaccctgtttctacaaaaaaataaataggaatagcgttcttcccacatctctgaatcagttgaatactctatgagtgtgtcccctgagtgggctttgtatgcccctgactccaaaatcttggttggagtcttacatctgggaggtgaagcttgagggctagggcccatgtactgcttgggttgtggggggaaatgtataaaaatagccccccacctggacaacctcagagtcttattttcacactgcttctagcatctgccttcatggacctaacaattatgtcaacatcctaccttgaaaatgctccacttctgaagatgtgcttcgagggagtacacacaatccttgccactcccccaagccttgcttctgcccagacgcggcctggttccctggggagaggcatgcctgagtctgccgagacgcctgctccagaatgttttcagggcccgttccagctcttaggttctgtggatctacgtgagatcacaaagctgagacaggcacactgacaactgggtagatggcacaacagtaagttaatccaggagataaaagagaaagcgagacaggaaagaatagggtgaaatcccagagggagcgccagggcccctgggacttccagttgcttccagcggcagaaagaggacagctccagctgctacagcacctcccaggaccaaacatggggaagtctacccagcaggtgctgggagagaggcagccccaaccagagccaatatcagatgggagttcctaggggaagatgatcccactgggcttgggagtaggctgggatccctctcttctccaacccttcactctcccatccagtgcgctcctgtctcttccttctcttcttttctcctttgctctgacttggtcctggtggtgaaggaccagatgtgagcatcactgcctggcttgggagaatctcttgggtggctgggctgggggtgcgtgcacaatgctgaatcttactccatttgttttcaacttattcttgctcccttcttagcatcctgctcttctaaaaaggaaactgtgatttccctgaataaactagtgctttcattgtccagcattggcaaggaggaaaatgctctgagagggcaaaaagtagttggatgaccctgactctctccagcttcaccttcctttgggagaatttctcacgtatttagtacgaacacctacatactagttttaaggtggtgccattttcctctaactgtggtgggccaagcttgggtgcatgactttctaacctttcgctaattgtctatgttgcgttgagagtctggtgggatgtttagacaggacgttactgaaaatgtggagacagaaaaaaggaaatgaatggaggctgacagagctagataactgccctgtagggcatagctcatcttagctcacagaccctgccagagtcctcatttttttggccttcttcatgggctgggttcgctcttctcactgcagcccacaactggttatccacccttctaaaaatcccctgctaggagagttcagcccaaagaggcagataggaggatcacctcttccaaggagtttaaggcctctcttctgggtgctactttcctgttagatgctttccttttctgtgatgattgaactagggaaggagaacttcccttccccatctagggagagagacttcctctccatctgaagggtcctggccttactcctcaagataatggagaagaatttaatatagtaaattcaacatctccagccagtatgggagatatcataagggacaggacacatatttcctttttagctccagtgctccaggcctcagcttccttgtttgtggagtatgcatatttagagttcctacttcagtgttgaggactctctgtgatggtgaggttaatacatacaaggcatttagaatagttcccaatgaatgacttttatcagtgatgtgttcccagcaggtctgctcagtgtgtgagtctagtccatgaatggcccagagtgggaagatagcatcaccatccacgactcaagtgaagcacatcatgatttttcaaagtattcatctatgcatcccttattagtttccataccaaccccagagtgtaagctccacaaggcagggaatttgtccatcttgattgccactatatcccaagtgcttagcataatgtctgactcatagtagatgcccaataattacttgttgcatgactgagctctgtgagttagatggagtgggtagtattaatccatttgacagaagaagaaagtgagtcccagagacatgatatgactcttctaaggttgcatcaggagttagccacagagctggggcaagaccctgagtctcctcagtcctgatgcagtgctccatccccagtgtgctgttagatctatcaagagttgtgcctgctggtaggttggaagcagggaataaaccctgagctgccaccaggtcagcttcatggattccattgaccctgcttctctgggcctctgtgcacacctacatgtgtacatgctgggagtcagaggctgtagagactgtagactagtggcatctgctacatgaaatcctgccaagggacagctttggagaagccttctgtctgcccctgagctaagtgggggtggaacatctgaccacatgccctcttgcaccaggcgttgtccacgttaggcttccaagtgttgggcgtggttgcagggtaaggctgcatgattgcaccaggcatgttggtttggcctccctgaggtggtgcacagattgcctttctgtaaataggatgtctgtcacctgaggcatttgtaccaggcacctcattccttttttggcttcctgtggatttggaaggaaactcaggggccattttttttcatccttttccctccatataagactataccaaatatattccagagatattatttgctcttaaaaaggctcaagaaataggcctaactacatctgaaagtttttctaaatcaagggttggcaattttttttttttaatttgtaaaaggccagataatagagattttaggcttttctgggccatgctgttgcagccactcaactatgcctttgtagcatgaaatcagccacagacaccccagaacagatgagcatggctgtgtgccaataaaactttatttataaaaataggcatcgggctggattgggcccttaggctgttggtttgctgactcctgttgtaaatggttatctttgggtcagcccatctttggtcttgctagtcttgggtgctgcttgagtcagataatccaagagaaataaaattccatgttgactcctctccttagcctctgcttcaaaacctttttaagagaatatttactcaagaaagagcttggaaggtcctggaaacatgtgcctttcatgcagatgccttactgcatggagaaaagcaggctttcaccccaaatttctgttgatctggagaagccacacagaggtgggcccggttgggcagcctgtcttgggtgagtttgggttactgtaaaagctcagacacttgggttcttggctctgtatgccctccctccctgtcttcctaaagccaagaaaaatgaaaggcgagggctgtctgaactagggtgtgatatttaagtcttagtgggtaggttgaaatataacggagccgttctgttcattgagccaagcctgtggactccttaataatccatggtcgggattgcagccctgtggggaggcagtgggagccttcagcagcttgaaagtagatgtctggattccaggaggtacaagcttccaagaaggaaattttcgtagctcatctttgcacaggaaggttttaatggaaatttgaacactcctagtaaacacccttgctattagcatctttcattttgacagaggagttttcttcctctgttctgatgggttatccaggctgggctgggttcctgtgtggagttatgggctctctttagggaaacatttggtgtggtagaaagatcttggtttctggaatgagatttgtgtcttgaccatgtgccattaattgtaggtaagatcctcaggcaaagtctttgacttctctgagctttgggtctcactgttgctgggtgatggaatgagagtgggtttacaaagcaccaagcacagagcccgacacatagtaggtagcctagaagggaaaacagaactccagttgctaatgcccaggtctgccccgccatctttggggctgggttatctgtgtgctcccctgacagggagccacccaggattcactttcaaagatgggaaaggaggcctgaaggggacatgctaccacggagtgagcaggcattcctaagagtcggtctgtcctttcctctcccactggagatactcagccagtgtgggggccatgcagcaccggggaagggacacatgtctgggaatattggggataaccttgtgtgaaatttttcagaacaggccggcagtggcctgggacatggatagctcaggctgcctgctttgctcctgtgcttgtcctcgtgacttagattcttcaagatggaggggctccctggctggtcccctacacaaggcccctatatctgtgctgggtggtggttctgatccctttttccctgtggggtggatcagagcttcctgtggcttctcggtggggctggagggccctagcacactgtgaactagtgggaggcagtgagctgggaattcagtggaggagggagagggaataggaggaggatgaggaggaagaggaggaggcagttgagacagttctctcacttatgcagaaagtgtgtgatgaaagtgtgtgatcacagccagccccacacagactttcctccaaatgagaagggagtgagaaaatgtaattttagtgtctggcttttgactgactccctgtggaggttccttctgggctgtggtgttgggtgtctctccttccctccaagggacagccaggcctgggcctggaataagtgagttcagatggtaactggggaatggccatagggagggagtgaagagccgtgcctgtgccccagggggctggggggcttggatttcaggacatcagggaggtgacatcaaggacactgcaggggggatttagggacagggtagtggggtcagtgcctgactcagtccgagctgagctatattgggtctctgttcctacgctgaggcatgctttcccaggcgtgaggccatgttttccaggccacagtccacagcctcgctgccaacacaggtgtgcattttggtggaggcttgctaccctctgtgtgaaaccaagggagcagaatatttccctgaaatcggggctcctggaacatgaccctgccaggaagctcaaagtcctgggagaatatgttccaggcagggcccggggggcacctccatgccccactgccttgtggctcctggcacaggagatgctggacagtatatactctgctggctggacaggctctcatgtctgcatgtgaaaatcaggttctggggagtttataaaccaaagaaaacccctccacccagcccacagagtgccagcgattccctcagtgattcgtgtgtggaggattcacacttggtggaaaatctacttaacatttttatcctattttccctccactcactgtcagtcctcatgtgttaggggagtggaaactcatttaaatatgagtctatgaaaaaatttaattaggaagataaattgaaaaatgcatataatacatttccgtgtcagacataaattactttatccacaccactgcacccctccagttaacccagggagttgggagttgtctgtgggatgaaaccctcttaggagattttccggaggaacccaactattaggaactccttcaaagcagaacttaaatgatagcatatagttaagtacatattagaaacttcatgattccatttaaactaatcattcagtgacttcatcgtgggtcagaaaaaatatgctctcttctcggtacattttgcacctgcagaaggatcacttggggaggaagaagatggggtagatgagggtcacatgatttttgtcttcctatgttggaagacaatgcttatggaaggggattagactttttgctgtgtccccagggagcagagtcagtgccattggttagaagttatagaaaagtggatttggggtcaatatgatgcaatactttctagcaaagaattttggttaaaaacacaggctttgtattcaaccacaatgaaaagctgaagcccagctctgcaaactactagctgggggacctcaggaaaatttacttctctgggcttcagtctcttcaacaggaagacgggcaaaactatagtgaaacctcataccttcatagagttgctctgaagatttaaagaatacgcttagctcacagttagggaaattcagtgaaaggtggatattattactagaagatagggtagcagtagaaagaaaatttgtggtcctgtaaaattgaagttgccctgcagtgggatggggcatatgaggatagtgagtgcttcatcatcactggagattttgacagcagcttggtgtgtggcttcttctcaggagtgatttttggagattcaggaatcagattcctgggctagatgccgtgctcttcaagtttagctgtgaccctctcaaccacttgggaattttttcctttaaacaattataacaattgtttttgaaaatatcaaagttcagagaagaaatttaaaaattactcaaaaatctcacttcctagacataaccatcatgaacattaagaaaactcacgtaatctctctatcatcacacacacacacacacacacacacacacacacacacacacagctggaaagatatgtagatcacagattgacaggaataattttagaataatgggatcacactctacatcccaattttaacaaagagtattaacgtacatggcttaaatttctaagaggaaacaagtacatctaaaggaagttctgagttctggaaaaatatgtcttcattgaaatggatatcttttagaagagctcatcaaggttatgaaaaattttaagaagatggagtcattgctttctgttaatacctagtttcaattttagacttttgagcccatgttataaatgatgaaaaaattagcaatcacctgcttcttcctacctcctaccccctttcttattttaattatagcttatttttacattgttaaggctgataatatctaacaagtccctgagttgtttagtctcaagcatgtcccctacgtaggaattcaatttccagttgtattctttctgttctagtttactcgacaatctaaaatgggattattttggtctttgatttgttttctttgacctgctaacttttctgaattcattgaatatatgtttttgttaatttcttctatagcattaaacatttgcaggaattttctttgtttctttggttatgttttcttctagagaggttcttcatcatcataatagcacaatatgctattatgttccttattttcctcctgtagtgtgtgttcacaagtgccatattttttttatcttgcatatgtttaacttgggtagctctgtccacttcttctaatcactctgatattgagggcaaattctttaggactccttttgtgacttacctgaaacctctgccatggtgtcagctccagtttgagatgctttctgatgcctgggagcattataggggaacatgggagatgagggtggtcagactcagagctgtgtgctcctttgggtaggaccacatttaactcttgcatgactttgttaaatgtgctgttccagggctcattccactaatgaggggatataggaggggatgtccttgccatttagatgatcccctcaattaagcgttgagccctggaacctgtgtttctgtgagagaaagagagagagaatgagagagagagaaagagagagagaatgagagagagagaaagagagagagtcttgattgttcatgctgctgttttatagctctttttctaatagttctcaatctgtttccccaactctctccgtattaagtcagaaaagaggaagaaatgatgtcacactcacagtctgcttctctgcaaatatatagtaattagtgagaagtctaaagattttggcctcagcaataatacttctgaagcatggggtggggttaggaacctgacaacttctgccaaatcctgttcctgcccccaccctcaccccaggtcttttagatgttgatagtatgagtgtgtgccagttccttgtttgattgctgcttgcttttctccttcacttattggtttttgtttttttgttttgctttgtctgattatgtattgggacactctgccatctttctccaaaagcctccctgcgtatcttttaaaaaaatacaatttcctaggctcaacacagagctatagaattagattcccttaggggagggccacagaaatttatatttttataaaacttccaaggcgttctaacaatcagccaagtctgggatccattttaagtttcccctaagattctttccagtgctgagattctgtggttcattgtgttctctttaagaaacagggagggggtgttagcacagggattctgtcatattctcaggcatggcatcctctcactatgcagaagaagggcttatgtctctctttatgccaattcttccttttgtcttggtccatttgggttgatataataaaaatgccttgcactgggtgatttgcaaacagtagaaatttatttctcacaattctggaggatgggaagtccaagatcaaggtgcttgtggtttttggtaagagcccacttcctgcttcatacatggagccttctgtgtcctcacatgatggaagggaccaggcagctctctgggacctcttttatagagcagtaatcccacttataagggttaaaattgctacatataaatttttggggagggacacaaatattcaaaccattgcaaagggataaggttggaggatcttctcatttctctttgtcacaatgacctaaagataccctccatgttttagcaaacttgcccttgagttagtgaatggataagttgttctcaactctggctgcacattaaaatcactttggaagcttttaaaatattgatgcctgggcctcacccctaggcatgtggagttaattggtctagggtagggccaaatcactggccttttctttgagttccctaggtgttctatctagcgtgcttccaagactgagaaccagtagattgttctttcttatttttttagtgactcatgatccattctccattttccttactcctatctcaagccttgattttggaacatgtactttctacacactgaatagtttctaaggtaatgttacttagaacaatagagtcacgtagtttcaagaatgggctttggagtaatagaaatccaagtgtgggtcctttttctgcccctgctgcttgtgtgagcttgaacaagtaacctaacttctctatttcacagtctcatgcaaaatagggattttaattctaccttgcattgttttgaggaacaaaattagtttcatatcatattaattacatgttacactagttttcttgtgggtagagtttttctgacatattattttttgtctttttattgtcaatcttttaataaggcttttctatatgtttcttacaatcatcaaataattgaattttgtttaatgttttcatctggtttgataatctctgtcttttaataggtacgtttaattcgtttatacttaatatactcactgatacaatatgtgagttttttctgctgttttattttgggtttctttgctcctctttccccctttcctgtcttatattaaaggaattgttccatatttcttctttttttaaattttgttggttcataagctgtagatcatattctgttctcctagtgattactcttttttttttttgagaggaagtcttgctctattgcccaagctggagtgcagtggtgcgatcttggctcactgcgatctctgcctcctgggttcaagcgattctcctgcctcagcctcctgagtagttgggattacaggcgtgcaccaccacactcagctattttttttgtgtatttttagtagagttggggtttcgccctgttgaccaggctggtctccaactcctgacctcaggggatcagcccacctcggcctcccgaagtgctgggattacaggcatgagccaccatgcccagccttctcctagtgattactcttaaatttttgagatacattttcataattctgggaacattgaaagtgataacagtatttttactcaaataatgtattcaaaatattcagcacaatgcctgacagtcattaaaatgcataataaattccaattgctagtgctagtcttactactgccagcactacaattaatattaccatttttacccaaagagccactaagtattatttttatccataagtatggtatcaagaagatgaacattgtgaaagttatatgaacaaattatagtctgaacagtgccagtttttcccaaaggagtttgctcatttgtaaaatgttatactgattattcaatgaggtaagttctgcagagtgcttagcccacagtaggtgctcaatcactgttagcctttatatggataccaacctggacttcccttttaaaacaccccagctttgccttattgctctgcaagccagttctaggcatgtgtctctttggctgtgaccctggatccaaagcttttggggactgagtgtggatgtgactgctctgctccacctggctgggacatagcaggacaggcagcaacccaggtctgtgaaatcaatcatgatgattctgggaggaattattggtgaattagggggatgctccaagggatggtccagatggaggtaggtgtaaagtggagttttgctggaaggagttgtttttgcacaacatattgatttccttggggtgggagaaaaaagaaacagcagctcttcgctgctctcccagagtggtgggtaggagaggacaggtgggagtctgtgggcccctttagctggttatttttttagatgtaccatcaggtagctgcaactgtattcccactgcttccccagcaatgcaaagggcagattacgaagcagagctgggctggcagcaagttttgctttgctttctcccagcggccaacagcatttgcattggtgggtggtgcacacactctgcagagagagggcgatacccaagcccagggcccacagactgagcacagaacagaaaattagggctgggaattcacccgtggctcctcagtgtctgtgttgcccatctctgatagacttccaaaatagcaggggccaggaatttggtggggacacctggggatgaggggccctgccagagctgggttcattcttgagggaatgtctcccaaatctgccatttaagaggatagagtttcggtccccaagctcaattctgcctcacctccatgctccattatctgggtatccccaggccactcacttatcccacccatgtctattctcttacctgtaaaactagaattgcaggtattttagtggatacgttgttgggagatgactcataggttttgatcccatctccatctctgcattatcttggacaagcaacctgacttaggtgcttgcttgtctttaaaatgcagaacgttagtacctatcatgctagctcattgggaagttgggaatggcaaataagagaatggccttgcaggctcttgagggaacagaaaagagaaaagtgggttcctcagagacatatgctcttacctagggtgggggagctggtttatgaatggtgtaagtctcagagtctccagcttcttccctagggtcctcccggaccaaccagcctgtattggagtgtgttcagcctcttgggtagatgtaggaccgtgggtggtgacatgaaggagacaggttactgctcagcaggaggggggacctatgtacggagcctcctagcctcagaggcagctgttactatgcagagccttcatgctgagccctgtgctaaccactccacacacactgtcccctgaatcagtcttgacaaccagcccttcacaggcagggagcaatgggattagatgccttttgtggcacgagaacaggttcatagaggccctctgttgggtcagattttaactccatatccttaggttttaaggagatccatggagtctgtggcagagggaccaaggtgggggagggggtgccattgatggatcatagatgggactcaccatctagctgggctgttgaggactccatattagcctgggagtttagtactggcattctccaagacacacgtgaagaaattgaggttcagagaggtgaccttgccaaggccacacagctagtaagctgtggagctgggattctaactcagatctggttgactcagaagtccagctgggggtaatgatggcaatgaaagctctagagttggaagagacccagacaaagcgggtttggggctgcttcagcgaccaaggatcttggggagaatcctggcccacgagaccacagtggattcacctgggtgctgctggccaagagtttgagtgtgagtgtgtatgggtatgtgtagggtgtagggtatagcacatgtatgcagtgtgagtgtagagtatgtgagtgtgacagtatatgtgtgtttgtgagtgtgtagagtatgtgaatatgagagtatgtgtgagtatgagtgtgtctagtgtatgtgtgtgtgtttagagtatgtgtagagtgtgtatgtgaatgtagagtatgtgggtgtgtgtgagtgtgtgtagagtatgtgaatgtgagagtatgtggacgtgtgtgagtgtgtgtgtagagtatgtgaatatgagagtgtgtgtgagagtacgtgtagagtatacgaatgtgagagtatgtgagtgtgtgtgtatgtgcgtgtgtatacagtgcctccccaaaggccccactccaccagcagcctgcccatccatcatcataacgggcgtggaagcccattccattcctgctgagccctgccaaaaaatcagtgagggagagccaggaagaatgtgcgccgggaggagcaggcagcgtgttgcagtccgaacggcccactgtgatgatttgggtgacgatggggccagcggtgccaccgagactctgatggctccttaggagttgttatagtcacaataatagattgttctctgtttctcaatgctaggtccattctttaaaatttttttttcttcctttagaggcagaggaggagatggagagttggtgagattaggattttaggtgtcttcaagtcaattctgaaactctaagaagaaatagagaattctgagtgattttaatttttctgcagtcatggggggaatttccatagggaagatgctttccaaggaagctcatgtgtcttggactctgaaagagcccttctcaggcctggttctggcatttgtccatggtttggggaaggtgggccctgggtgggggcaaggatgtgacttttggagcaaggtgtgggcactgtaggctcaatgtggttctgctggggtggtgttcttgtggctgaagaatgtgtcccctgagttggcacagtgatgcatgacataggatggaccaaacggaaggcatttcctgtcactgaaattaaaggagcaggggggtggaggggaagcaatggagcagaagaggagtttggttctaggagcattcagaagtcttgggagtgttgggttaggtgacacagttcctgtctgtcctggggctctatgtactccccctggagatttcactggaactggtgatgtcccgtgtttagggctatctctggaaaataaatatgaacataaaataataagaggctgaacctacgaaggaaatgaactaaagtcaatacacatttttcccagacaccatacaaggtcctgcaaatcactgggaaatgaatgggacacaagacatcacactccatgcggtgagctttgtgtttggtttttcccagtcattggctgtggtgaatcatgtgttctccctgtgttcaaatggctgttgagagaaaggtgtggatgttggcagctctggggaggagaccagtgatgacaccaattgagggtgcactatggtgtttagatcattggcttttaaaatttagtcaatgacttctgaagtgggcctttttgcttccagctgacagacatatcagagtgcgggagacagagtacccaattccaaccccaacatcctgcccacaagctgtgggaacctgagtaagttactcacctctttgtgcctctacttcctcatctctacctgggggaggcagtcaacgtacctaatgttattttcatagtaaggctgttgcacagaatagatgagttcgtaggtatgaagcccttagctttgtatctagcacattctaaatgataaaaatattggcattactgtcactaatgaggatattgaagatcagtgaagtgagggaattctcccaacactgggaagaaagaccacagcaggaagtaagctctgggaaagcccatgctgtctgattctaacaagaaggatgctggcgtcctcctgctccgagatgccaggaactgtggcctcaaacctgagggacaattctaaactccatctctagacaaagagtagttgccaaaccaaataattccgcaaaatacacatgccagtgcattttcctttctttgtcttaatttttatggatacataatagttttatgtatttatgaggcccctgtgatagtttgctgtgagcacacaatgtgtaatgatcaactctgggcacctgggataccatcacctcaaacatttatcatttctttgtattgggagcatcccacatattctcttctagctattttgaaatgtagaataaattcttgttaactacagttgccctgttgtgctactgaacactagatcgtattccttctatctacctgtatgtttgcacctatcaaccaatccctcttaatatcccctccccactacccttcccagcttctggtaactaccattctactctcttgctccatgagatagttttttagcttccacatgagtaaggacatgtcatatttgtctttctgtgcctggcttatttcacttaacataatgtcctcctgttccatccatgttactgcaaaggacagaattccattcttttgtatggctgaataacatttcattgtgtatatgtaccacattttctttatccatttgttcattgatggacactcaggttgattccgtatcttggctattgtgaagagtgctgcaataaatacaggagtgaagagatctcttctgtgtgattgcttttcttttgggtatatacccagcagtggaattgctggatcatatggtaattctatttttagttttttgaggaaccttcatactgttttccatagtggctgtaccaatttacattcccaccaacagtgtatgaatgttccctgttctccacttccttgccagcatttgttattttcagactttttgataatagctgtcttttaaaaaactgaattataactacttccatccgtatttttcggaaggaggggaataaacttcttggaccaaatctgatgagtcctgagatatgtggggtagatgaacaggagtcaatggtgggaccttttgacttttgagccctggttggagtattttgggatgttagagcgtccttctggaattaagatgtgcttagtaactgatgtgtggttgctactggagtgtgtgcatgtgtgtagaatttaagaaattataattcatgcgccaccttcatataacatattcatgtaaagattggcacttggtgaatctccacgacccttatagcatccctgtagtttgtaggtgtggttgtagatataggttgtagattatgggttataggttgtaggtatatatggtatagattgcagttgtaggttgcagggtataagttggaggtacagggtgtaggttttagtttgtagttatatgctgtaggttatagctgtaaatggtaggtatgggttgtaggctgtgggttgtaggtatagattgtaggctggaaacagaaagaacattgatcaaacgtttgtcacttctttgttttgggaacatctcaaatattttcttttagctattttgaaatgtagagtaaattattattaactgtagtcgttctgttgtgctactgaacactagatcttattccttccatctacctgtatttttgtgcctattgtatagatagacctggaccttgaacccagaacttttgatgcccaaatccctgatcttcctgagtatattaggttccttcaggaaaaatgagatgcttttcagtggtaatgtttatgcttcgctataataaatacacataaacgtggatagagaaaggacctcgtatctagtttcttcctaggacaccagttggttatcgtttgatgcattttctttaagcctgcttgtaccaattttttaaattatttcaacttctttagctctgactgtaccctctgccaattttgtatgctgccttctgcctcccagttactataacaaacatctcctatgtaaaccctttttatgactacattctacttggtatggctgcaccataatttctctagtgtaggatatttaggctgtttctgctgtttggctattataaataacatagcaataatcatctctgagctagaagttttcctaatgattttatctttaggtttctgggatgagcatagggctggatgtttgccaggctagggagaagctggggaggagcctggtaacgccctgagggggaagcctggcctggagttacctggctgcctggctcaagtgtgcccttggcaggggctgctggcctagaggccagcaccaagcagcatagtgggccagctttggcatagatggagcaagagagggaagggttctccctctgtaatcaggagtagaacattcaggcatggagctaagacaaatgagtaccttttagagctttggctctatagagacagtacaggtggccatgaggtggtaaggaacagtcacacatttatagcctccccacagttcatccttctgatatttctgccctgagttaccaatgagcaacaggcagttctctcccacaaagcctaagcagggggagttcatcctcctttgttaggatttgattttatcagagggatatttggaggtcagtggctggaagaataatgctgtcagagtttggtgactcttgccgggcagtgatggaggtgggggaggggcagagcctggcacacaaatctggggaagagtggtgggatgcgggaagaaagactggtccctgtactcaaggagattaggatccttagggcttttacttccaacatttactgttcctcctcccgggatgcctgccttcctcttgtttggcttgtgtttgcaaatgaagcagacaagttctagagaagttaaatgatttgtcctaagtcatgtaatcattgactagggaagggaaactagacccggagctccagcttcacgggtgccctttctcctgtgtcatgcagccgcttctgtgtgttggctagtctgcccagtagactctgctccttggggctctggttgtgtctgaccttgttgaatcccctgcatgtgtagtatgaccttgttggggtgtctcaacactgggcatgttagcaacactgagggatgaaagcactgtcatgccctggatggtcagccctggtttgttgaatgcacgagtgttcatatgtcagaaatacatatgcattcactctacaaatattttcaaacatttattatgttcccagcataatagtagagcttctactattgcaggggagaaagtcttcaataaaagttatagaataattaattacagatggtagaggagctaaggaagagagtgatttcaggttgccaagagaacatactcagagaggcatgatagcttttggggaccctgtcagtatcatcaggatagcccggactcagaagttagtctctcatagagccaataggaaggttttggcaaatctggattttttcacttgcattctggttttggttctgctattgactatcagggttactttgaaaaaaccatttgcttctttatgtcttgcttgctttatctgtaaaatgaagaggttgtaaaattcttctgtaaatcatttaattaccaccctcttcccccatggaaacaaacctagaaaatcctaactttgctttaaaaatattcagtacatggaatattttagtgttcatgttttctcttttgagtggggtttggccattggctggttcttggataaaatttggagggaggtattctccaggcttaaatgagtgaaaaagtctgggaaaaaataaaccaaccctacctccttcccacccaaggagtgtcctttgcatctggcatcgctgtgttttcattcgctggtcagtccctcatctgctgccaacctcttcccttcctggcttggtcagaaggtccagagagcccactgtactggcggggagaatctgtcccttttgcgcacatcattgggaactcaaagtcatctcgtgttggagtcaaatgacgtgttagcacacgcctgcttgggggatcctcctgcagttggcatattgcgtgacacacggggggattctcatcgtgctggaatgcatggccagccccttctttctccaagcacagttcagtgcattttccccccagttgctgcttctcgtaggagattatttctgattcatattgagttgttactggaaaacacttcagagagataatgagctgggtagttttcctcttcatttttctttgttgttgttgaattcatatgggtaactgggctctccacttacactttattgattcctgaatttagggcatagctctgtaattggcaatttcctcagtgccacgtgggcagagagaagtactgtgcctggggctgctgactctgcaggaagctgtaggggcacttccttttagccctggactgacacagctgagtgcccgtgggcaagtcccttgttgcctctttcttggctctggtttttccttgctgtcttgtgaggggtcagaccagatgactttgagcaccagcccttccagttcttgaattttccaggctaggttggaagcccttttctttggtgggtttatgcatgaagggccgggtgtttctgtgttcacggatgacactgctgatcccatgtgctcttgtcattgttttccttggagggctgagggatgtgtgctgagtcacgcacatgcacagccggagtcccttgtgactaagctgtgcatttgcaggagcgctggcagggtcggtggtacagcctctgaactgggacagcttgaacccagcgttgcctggagtgggaataaaccttgaccttgctggcgtgggtgaggggcacctgcccagggagctaactggtctggactcatacagtgctctccttctgtccatttcagtatgctggctgtcagctttgtttatgcatagatgaattactctcatttcagattatcgtggaaaatcttgctgtcaagttcttaggacaggattaagtagaataggtgataaaggtcattggcattatttacaatctcttgactttcattcacccccatctgctgtagacaagctggatgcttacaagagcggcaaagacttgggacttagaatcaggcacacccaagtttgaagccccgcgtggtgctttctggctgcgtcaccttgaacgcttgcttccccaagtctcggtttttctaaaatggtaggaaacagctttgtttggcctaagaggtttgctggtggagactaagtgagctactgctgtgttttgccacacctcaatgctggtgggatgcaagatgctttgaggagggacacagacgaatttcttattatagttgtgtatttgaatacacttgtggaaaaatagaactagtacatcagagctcgtgatttcacagatattattgcccaggacaatgctaatttgaaaaaatcgagacaatttcaagttgatttcaaggataatatgcactgaatattagtgcaggcaggcaggcggggcagaaatcaggaagatgggagagaatgacagaatttggagtactactgagacctacactacaggtctcctatagaacatgtggtgggagcagaataaatgcatctttctctttgtgtctgtcctggtacaaggaatgtttggggcattggtataagaagctcccagagaaaaggtgatggtgacttagctttgtgcactgcatcaccctcacaggcaacgctgtctgctctaggcgtgacttgcactaagtgaatgtggacaagatggccactttttctagatccttctggggaagctgttagttgtaatagtgttagaacctaagagctagaagagactttggagatgatttactgcattttatgttagacttagacaatttttttacaaaagggaaaaattaaaaagccccagagagacctggacttactcaaagccacacaagtagttgagcacagtggctgagatgaatcattttgtgtctttccccaaggatctctctttccttgtccctctgtctatcctggtcaatagcatcattgtttgaagtgagtttttggaacaggacccagctgcattcggtgggttagtccagcaccacaaggatctgtcctttagcattgcctgtgtctctggccttctcgtgttagttagaagattgaggaggcaaccatgtagacactgctggaggaagaggaaacgaatttaaaagtcacaagttttggcctcagatgcctgtggtgttgaacattattagctttgttgtcggggcatgcgcctgacctcccggagtctcaatttcctcctctataaggtggcttttacctctgcaggtttgaatgaggtaagaggtggggagagcctagtacttggctcccttgaagaaagtagcggagactgaatccaaggccaggctgtccactccaaactgggattaggatgtcatggttcttcagcccctgactttcctgacaaaggcccacgtgggggctcttggttggcctggtcactctctgcttggggtgtcctcattcttttccctggagaggttctgggatcaggggtgagaatggggttaagttatctaggaattgagagtcccttcttcataactaatttttctttcctatctcatgacttctagataatagtctgtagttttaactcatttgttatttatataatttctctgtgctcggctctaagggtataagagtaaattagatctggcccttgcatggaagaagcttacagctgaggtggggagctctgtctagcatgcacagaacatggtgctttgacaaagggtaggtgccggggagtgaggtgggagccctgaggaggagatcttaacaagggaaagccttctacagcaggcaggggctgagctgggtttgaagggctgagaggagctaggctggctgaggtgggagggtgctggggtggcaggggctgcactcctggcagagggaatagcacaggaaaggcccagaggtgagctgggaaaccacaggcagagtggtgcagggggaaaaagaggggagggcaggaacacagtgggggaacttagtgcataacaacaatgccctcaacccttttgcctggctcttcaccacgtgagaggactcaggggagaagagtctgagtgctgtgccctttctgaattctttttttttattattatggtaaaatatacacactataaaattgaccattgtgagattttaagtatacaaccagaattctgttcaaccatctgtgctacttacttccagaaccgtccagcactgcagatggaaaccctggaccaatggggagtcactgccgttctctcctccatccagcctgagaacctgtgatctgcttgctgcttcttgaggcctatttggatatttcctatgagtagaatgataggatatgtggccttttgtgtccggcttcttccacttagcataatgttcttgaggttcacctgtgttgtggcatgcagcagtactccgttcctttagttctgtgcatggccacaccacatttttcttattcatacatcagttgatggacatctgtgttgtttccgcctttggctattgtgaatagtgctgctatgaacacttgtgtacgagcttttgttggtatcttttcttttctttttttttttttttgagatgggctctcactctgtcacccaggctggagtgcagtgacacaatctcagctcactgcaacctctgcctcctggttcaagcgattctcctgcctcagcctcccgagttgctgggattacaggtatccgccatcacacccggctaattttttgtatttttagtagagacagggtttcaccatgttggccaggctggtctcaaactcctgacctcaggtgatctgcctgcctcggcctcccaaagtactgggattacaggcatgaaccactgtgccaggcctgtgtttgatttggggtatatgcctaggaatgggattgctagatcctatggtaatgctgtgtttaacttattgaggaaattgctggattcttgaggatgtgtttcaggtccaccctctgttgttgccttgaccttgttacttgctctgttgggtgcaagctctgaggcatgggctagacaccttgtgccaggtcctgttttccatcctcacaagcaaccccaggtggtgggcactcttcttggtcctggttttcagatgaggagatgcaggcacagagtggttaagcatcatacccaaggtcacacagcttgtgagtagagggtctgggaattgaacccagacaggctgtccagagtgcagtctctccccaacacaccccatggtgcctcagagacaggagtcccatagacaacatcctggatggagcctgtagcctcctgatggtggttggaggctgtgcgcacagcatggagcccgagccagcccctggggatgagggctgcaccagggcccactcagccaccctccaccctgtgttctttccttgccttgcctcccctctgcactccttccttgtgcctcctcctcactccccaccagcctcacctctctctcgctctctctctttctttctcttttaataaatggaaatggtttatgggctcttctagaaattgcacctgccttctggttataactggggagagagagaggaagagacacagagaagagacagagaggcctccttcagcagatctgggtatgcccatgggacctcctggcctggacatcctggtggtgctttcaggcctgccacagaagtgaccctgagttggctctggctctaatgtctgagagtgccttcttcccctctccccctgtgactgcctgcaggacagcgcaattcctctgccattgtgtaagcagcccccacagatgatactccatgctagggaattaactacttgttgaaaagcacttgtgtgttcccctggctgaggctgaaagtgggggatccctggggaagggggtggcctggctatggatggggagaaggccctctggggaaatgaagaggggagccccaagccagttcgtcctgtgggagctggcccagattatggttcataatgtaaatttgggagtatgccagggccatattaatactgcatgaggcagtaaggggaccttgggcttgaaacccgagctgtggcctagaatggaactgaacagtgggccttgtcttaaagggacatgacgagctcccagaagtatgtgtcggcattatttccctctaatgctgtttactatatttgtacacaatgcccccaaaggatttgaaaaggaaatggcaatgtaataagagaggtattttttgttgcacatgcgagcatgctcattgacttaattattgtttcttttgttaccttggtgaattagagagggggagatatggagagggaggatgggaagttggagagggggaagagagagagagagagaggagaaggaaacccatgtctactgttattttgctgaaatctatctcagcgagtaggcagattgagaaatcaaggattcattcacaggtagaaaaaaatgaataacactttgaaagctcagaaaatcaacacaacagagaattcagtttcaaggtgccacttttgactcttctgctgctctttgaattgagttcatggctgtgctcatcgtctccatggagaagggcaagtcagtgccatttcttgtaggaatgatcgggccactaacatttgtctagaaaccaagcaaccgaaaagtgcaaatatctggatgctattggcttttgagaaagaaaggatgtcaggcatttatttgaaagggtaacctccatccagatagtgttgtagagcattttctcagacattagaaagattcaactgtgtacagtagttttagtgttgagtgtttcagaatattttcattctttccaaattgggggtccactacattagttagatgcttttgattactaatgatcaagaacactgactcaaattggcttagacagtaaggaaatgtatctcccataagagaacagagttgggggaggaaaggctccactatggatggatcagtggttcagtgatgtggatgaggccctgggccctttcttttcttcaccctactgtccttagtgacagctttataccaagtctgatttctctcatggccgcaagatagctgcagtggttctggacatcacatctggacatggcaatgtccagagtcaaggcagggaccatctcttctggtgaggactttatatatagagaaaatctttctccaaagcccccgatacttctcccatttttctcattgaccaaaaccaggccacttgcctggctccaaatcagtcagtgtcaatagaatgggaatgccctgatgtaaactagacaggacccaccagctggtgagggaatggggtcagtttatctgaggtgcaagacactgtggagaaggagtgggaacctggacaagatggggccatgttagtaacgaggaggagggtgacatcttttgcctccatgaatagcaaagggcagttctcacttaactggggtgcacatggcatcacagaatgctagaacttggaagggaaattagagacaatcttcttcaatcctttcattttacacatgaagaaactgagctccaggaatgaggaggagttgcccaaactcatggatccaccctgggccccaggcaccagctgtgtggggccagtgggccgttgaagcactctagtcaatgccacacagcctgggagcagtaccagaacccagggtgggaaaatgttggcagggcttccagaaactacttgtagggcctgtcattttcattcaataaatgtattgatcaaccattgagtctccaaccctgcactttctgggtggttatgagaaagagtaaagttaaagaagcctcaaggcatctggaagagaacgggttccaacctgtaaggacatattccaggctggatgtgctttctcttctggagataattctcattttggtctcttttttcatattcttactgcctgattccaaggacttacaacagtgtctagaacacaactggtatccataaatccatatggaattatattaattagaactgcatgaggtccagaaagtattgttttcatcttattttaatgtgtatacattggctacaaaattaagtcatggtagatatcgtccagataaaattgtccaaagaaaaatcgaacacggtaccttactgaaagtgagctcatttgaggactgtgatcttgatggttgggtattgactgggttagggggtcaggcagtgacagcggcttagcctgctggtgctgagggaggccggggatcatatccgtgcaggtgatccatgacagccctcgaccccagtgtttagaggaagtggatgggctcatattatttcctcctcttccctcccgcataaccctctgagtagtctttagagccttctcttaccagctaggtggctctcattgtgcatgatgtcaattgcagaaaatgtgagtggggaggtagctgatagataatgagacccaggtccctcagtcccgagctgccaccctaaataaagcaataaagcaacccacaagctgcatcagtgtgcctggtattttcatttctcctctagaaacaggtttctagggctgtcgagaatttggaactcataccacacataccaccatgctgaggtttctaaattcaggctgcggtttctgcatgtttttgagagtgtcagaaacttcaaaacatttgaagagtcccagaggagaagggaatattcttcttcttattattctgagagagcatagtttgcacattcttggcttcttcagcatttggatgctggagctctgttggtctgaggctgaagagcaaactctgccaaagcttctcttaccgtggggatggaaagttttctgtgtctgttttattacttaggcattccacgttctccttcgacatctcacatactcctgctgctttcctttgtgagtggagacctcgctttctttataggtggtaacagctgtgttctctagagagtgaatttttgcaccacaacccctattctcacaataacttcacttggacatcgaggataagtttccatgtgagaaatattgtttagtcatttattttaaaaaagcttttaaattatttaaaacaatttgtgggttacatagtaggtgtgtagatttatggagcccatgagatgttttgatacaggcatgcaatgtgaaataagcacatcatggagagtgaatattcatctcctcaagcatttatcctttgagttacaaacaatccagttacattctttaagttattttaaaatatacaattaagttattattgactatagtcaccctattatgttatcagatagtaggtgttattcattctttctatttttttgtatccattaaccatcctgcctcccctccaatccgccactccccttcccagcctctggtaactctctttctactctaatttgattttttagatcccacaaatatttttacttttcaagttgaactatataatatgatactaaaacttgaacacaccacaaagtatatgcatattcaaaactgaacacacccatggaactaacatccaaatcaagaaacatagctgctttacactttcttgaaataagcacttacctggagatgcaaaggcacttgcgtgctctttcagtagcatttctcttctccagcatcttcccttgacatcagccttgcctgcacattgcccagttgggcaaatttctctcccaggtagaggttaccaggcttgcattccctatgttttagcttctgtcttggtctttctgtgtgtttgtatacctccatttgaagcaaacccaacacatgaaaagctatatttaccaatgggaccaactattggggcagtgtctacttactatacatatttttaaaaaactgtttctttaaattggagagctccaaggtgactgatgttaataatttataactatttattaagcacctactatgcggttctgtggtgtgattgcaaggggggggggcacgtccaaggttgagtaagacatagcttctgttcttaaggatgtcccagtctagaagtggagataagctatgcatgagcttgaccaagatcttgctacaatgaaagatagctgggaagagcatgagagagttcaggggaggaaaagaccactcccacctgtggcatggagggtcattcaggaggactacatagaggagggggcactttacattggcacttagaggaatctgccccttgatgggacccaaacttacatttatgatgtgaaaaatggaaaggagacttgttatgctttaacagtaggtgttgctatttaatgtatgaagcttactcaaatggaagagtttgggtttattaaaggaaattagaggtctctgtgttagcagttctgtatgttcaaaatgtgatacaatgggtttacttaaaccattggttgccccaagacccctttcttgaggaattggcagcttggcagagtttgcacctttgaaggctgccctgcaaggataaagacctccatccaaggggaaaggccagaagcaggctcagagctaggtcccacaactctgcttccctgtatccggcccccctgccagctcactcaagcaagccctgtttctgggcagcagcagctgtgaggtgtgggtgaggggctgttgctaggagcagggatccagcttgccttttctgacacgtgtgtttaaattagcatctttaaatgctgttcccgacagttattcaattttgaaactactggggattttggggcaggtggagagtgttaaggaggaggcgaggcaaatgaaaaggcaaaacatttgggggagtttttgaaaaagttaaataaggaaaagagtgtcagctgggggaaagcacatctcaggccccattgcaggaccccttccccagtggagtcatagagtcccctactctgccccaaggtgttggagatggctcatggctcatgggaatgtgcaggaagtcccctgagtcttatttatttatttatttatttatttatttatttatttattttgagatggagtcttgctctgtcacccaggctggagtagtgcagtgacatgatcttggctcactgcaacctccgcctcctgggttcaagtgattctcctgcctcagcctcctgagcagctgggattacagggacctgccaccacgcctggctaatttttgtatttttagtagagataggttttgccatgttggccaggctggtctgaaactcctgacctcaggtgatctacctgcctcgacctcccaaagtgctgggattacaggcatgagccaccgtgcctggtccctgagtcctcttagggtctccagaaatcactatatcaagtgaggtttggggatgggcacatctaagtgataaccacccactaggcaaaaggatcctggtgttgggagatggggtgagaaactggggtgggtgtcattcattcaaccgagtcatcactctcaagggaccagatggagaaagggaatataataagaaaaatgatgatgcttaaaataaatattgataatgcccacattttcagggaacttctatgtgccttagatatttatttatccaagagcctcacttctttttacttgtccgatccttacagcagatctccaaagaggttctctgttatccatggtttacagatgaggaaactgaggcacagagaggcagttaaatcacttgccccaaaccactgaagccataattggcggatctgggattgaagcccaagcttccgggcactagtgtgtgggcctctaatcttgcactttgctgccaccagaaattaggcaccaggatggtaactgaggaaaccagacaagagtgagaatgtaggggtggaggatggaagatgggtatcagggaggttttctgagttgaagacagtctgtcctgtggcttcttaaaggttgctttcagatgagggtgacacaaaggtgtccccctgtcctggacatgatttagaaccctatccacagagaacatgccaaattttatgcacctcagggcctttgcacatgctgttttctttggctggaatcactgttctccctgctttgtgtgttatggttctttctcatctgtcacacttagtttaaagctgcctcctgcagaggctgacacgtcgtagcagttgctccatgaaagtgttgagtaaatggatgaagaataaagctcttggcctttcagggaataactataatgagaaatttggaagatctttctgcagctgagcctttggaattttgatgtcttccaaaagctggggttgttaggagaagaggtaccaaagtggggcttcatctgtaaagacccagctggagctcttgttcacgcctttccctgaggctggaaggtctcttggatgtcacaggctgcctctttaaaatggagacagtggtggactttcctccctgttgaggatgggaatgaggatgagggagcaggcttggggtgagcctaccatccaggggcagtgaactttatatggcgtgggatgaccagtggcctcccctggggtggctgctggatattggctgatggatggtagaggaaacactattctcatctcaattcctggattggtgtgggggccaaatgagatcccatcattcctaattaagatgtagttacattaatgataaagacaacaatggcagctaatacttagagagtgctgctacctgctggtcactgtgccaagccctttagtgtgccttatccttgagtcctcaccagcccctatgtgcaggaacctgctgagatgaagtgacttgcccgggccacacacctggtaaagttggaaaccaactggagccagccccagacctcacattgcataccccagacctcacactggataccctcacactgcacaccctcacactgcataccctcacaccacatatcccagacctcacactgcacaccccagacctcacactgcataccctcacactgcataccccagacctcacactgcacaccctcacactgcatacccgggacctcacactgcacaccctcacaccacataccccagacctcacactgcacatcctcacactgcacaccccagacctcacactgcataccctcacaccacataccccagaccgcacactgcacaccctcacactgcatacctcagacctcacactgcacaccctcacaccacacaccccagacctcacactgcacaccctcacactgcacacccgcacactgcataccccggacctcacaatgcacaccctcacactgcatactccagacctcacactgcacaccctcacactgcataccccagccctcacactgcatatgccagacctcacactgcacaccctcacactgcataccccggacctcacactgcacaccctcacactgcatactccagacctcacactgcacaccctcacactgcacaccctcacactgcataccccagccctcacactgcatatgccagacctcacactgcacaccctcacactgcataccccagacctcacactgcataccctcacgctgcatactgcacacctcacactgcataccctcacactgcactgcatactgcagacctcatgtataccctcacactgcatactctcacactgcataccctcaaacaaggcccttttctgactgtcacttgcaccaaacagaatgcagaagttttctaacttgaacctttgaaaattttttctgttctgtgtttcacgaagggatgtgttaattgttgaggtaattgcagagttccctggctttataatcactcatgttatttattgttcttgttattattagtaaaagccatagtaattcagcctttgggttggaatggcagcaggagccagctgagtgaccttggccgtgatattaatactctttacagtcttccctcaattatccaggctaatggaaagagaaccagtgcccgcaaataatcataaaacaaaaaaaaatcaattatcttctcagtggagtgttgactgacacgtgggtcctacgccttttatgaggctggccttcaaacacagctgcatctttggtgatatttcagaaagcgtgaggtgggaaataatccctgttttgcaagtcaaggatggagaaggagcctttcatctctggatagagatggtgtgtggatatcaccagctgccaatggaggggtcagtgctgttattctctttcctaaagcaactcgggggtgatggagaaggttgccttaatcccctctgagcatttcactggctgatgtggactcatggaaaatgtcagcgtgctggcccaggccaggcgggctgaagccagtgtgtcttacagctctgtggagcagacgtggtgtgtggcttgaatggaaaggtcataaaggcctgggacaagggagtggacggagccaatggcactgtctggtaacactatatggaagatgaaattgtagtgtggagctgagaggtgcagggctggggaaagagacctcagcattttccatgattaactttctaatagtaaccatgcgtggacagtgggtgctgggcagcagggagacagtcttctccaagcgtgcattcatacagtgcaggcggcttcccactatctttgggttttctccattttgtctgaggcagggatcagaacatagacctattgtctttgatggcaaagtgaggaggcagccaacttcatgtcctcctaattgactcatttcctccccgctggagtccccaaagcataggtgaccaagagctccctctcagctctaagtcatgaagaaacggatgcttagagaggttacccagaagctggggacagagctggcaccacacccaggcctcctcccttccagtcctgtgcttgggcaggcagcctgtgggcttcttccttcggccctgtccccttccctcagtactaacacgtgctcctagatttctgagcagcccctagagagaagtgacggattcatactagagtgttcatgacttcatgtatcacttgcctgagagtatttttaaatggatgctgggggagggcattgcttaacccaaaggaacaagaagtggactatgaaatttcagtcccagggcctgccatgtgttggcctgttctgggtgctgaagatatagtggtcagcaagacacacatcctctctcctttgagacctcatatttcactgggggaggcagaaacatagtaaataaataataaactaacttcagataatgagaactggttttagaatatgaaacaggctaaggggatagtgatgtgagtgcaatggggaacctgttttatgtagttggccagggagggtctttctaaggaagtggccaatgagtggaacaagatcaacttgcctggaaaaggaaactatgggggatctttgagggaacagtacttcaggtgtgtggaacagcagctgtgaagcctctggggagggaacgaggctggctgctggagagtttccttggctaccctgattaacggcccctcttcctgcctcccttccctattttattattttctctggggcatttgtcaccatcttatatttgtcttaacacaccttatatttctcttatcagtttggcttatcgcctgtttcctcaactacaatgtctgttgcatggaggcagtactttacctgtgtttttcagttctacaccctaggaatgtgcctgggaaatagtggtgcttgatacctccttgttgaatggggaaatgaacaaatgcatggactcagcaagcaaggcagacggtgggaggagatgtgaccaggaagatgggcaggagtcggagggggagaggctgagaacacgggcccttcagtgtctgtgtccttgtctcactgctgctgggaggggctggcagaaactggccttcttgccccatgagccccaactcagcagaaccacccagcaggtcttagcatccccagcctggctgctcccagtggatgcaatgctcattaaccatggagctggtaataacacgcccatgtcctgcactgcactggtgcctcaaatctatgtgttcagccttggtgtaaaatcactaggagccagggacagagggattccagggaccccacgcccagggggcctgagaggctcatccttcgtgtcagcttgtgttttccaggggtggttttgcctgcccggttactgctgtggaattgcctctggcccatttatggtggaggcctgggttccggtgacactgctttctttctgtacaccttgaatgaggtcaggcagctcttcatagagggaggaactcttcctggagtgccaagggtagggtctgcctagtcccagtctctccagcctgagtttgcatcagggagaaaaagcaccagcacctttttcaccaatgcgcccttccccacattcacacacgcatgttcacatgcatgcacatgtatgcaggccggcttcccctcaccttttgttttttttttttttgtaaaaaacacacatccctatgtccacaaacaccctcaccctcacttcctccctcatccacagacacctgttccccagtgatgcacatttgctcacacacctgcagctgctcacacatgcctgcatgagaggccctctccacccttcagtctcccgtacaccggcaggtgcccaccccacaccagccgctcacacaggcacccccgttttagcctcttacacttgcacagggggcccttcacctgctttgcagcaccggagccggagcccagacacatgatgaggcatgagaagtggaaagttctgcaggtgctctgcccaccgtgcaaaggaggaggcagaggtccagctgcctctcagcatatagaggctcagaggcctttgcagcatgcagagcttttggaacgtatcttactttctcattcttaaattcattcgggtaaccactgtttactgtgcacctaccatgggtcaggcgctgtcctctgcaccgggcatactgcagaaaacgaagcagatgcaggccctgccctcattgggttaggtctagtagtggagacagaccacagacaggacaaatagggaaacaggagaagccaggtggccataagtgcacaagcacaaatgaaacagggaatgggaaaaaatagtgctatggagggtgcatggagagaaagctctttgttaaggggagtttggagcagatttcaggaaagggccatgttgcaggcagaaggaagagcaagtgtggccaagacccaggaaggatgggaggagggtggctgtggcggggcggagtaggggggtgggctgtgggtactctacatgatggggatttcttaaacatctgtcagacccaagagactgtgatcctctgaagcccctggatatgtcaaattcatctcagtggccttatgcacccttcgcatgcacctggtataggccagtgctcagaaaacatttgctcctggagaagttgctggttcagttctgtgtggagctgctctgtgttccaagatctgcgctggctgcagggataacagggatggaagagaaccagcccttctcttgaggagctccctgctagtgagggtcaatcaagtgcctggaagttgtgtgtgggcatgcagagtgcatgatatgccaggtgccgggaagcctcccagcccaggggctggagggaggggcactgcttagtgggcagctctttggaggagctgatgcttgaacagagtcttcaggaaggagaggagttagccctgggtggggaggcagagaaggaaagagacactgaaagccgaggggtgaaccacaaatatttgggaaatggcaccagcaaggtgtacagcaggggtttccaaagagttcctgattccctcctcaaagtgatgggagccacacttcctggcttatcagttggtccttgccctctggctggtgctgtgtgtctgagaggcagcctaggaagacctctctggggagaagcagagaaagatagcgacctctgaacgtgctccccagaattcagtcaccccatcctacctatgagaggggacaaactggcagtctacaggtgtgtttggtttagcccatgtggcttcattgttttttaattttttttttcatcaattgcctatatttacaaaggagattttggataaaaatctggattgctagctgtttttgaaaaaataaaagattgaaaatgtacctttgtgtgcctgtgtcccctcatggtgatgattggtttgggcagagccattgcacgctctcctttcccccccatcccccggtgctgaatgcagcacccctcactcaccgtaacaggctggctcctgtagacacatgaccttggatccttttttggattaaggaagcaaacatgtaggattgtgcttctgcaaattctcagagatggcttttgagcccttaagctcttctggggcattctcatttctcaactagagctagcgggtgagagccctctctctgttttcatctgctgcaggacagctggacttcactgtatctcataaagaaaaggaggtggggtgggcagggccctaggctgtattactggaaaaaaaacaaaaaaaaacaaaacaggcagtagctcctggtttctgtaaaaatggtgtctagacgtgagtgaagaggcagaaggtcagaggggatttggaaatctcaaaggctgagcacagagcgcccacaggtgcaaggagaaagtacagggccagggccagagatttcctttctcttgttcctcagcttattcttaccctattccacccaccctgccactgccaggtgctcagcgagtctttattgaaagagagattattaatatggtgaaatgtctgagatggttctctctccgcatacccagtaatacagggtccctttggcttgtgggagtcacatgtggccattttcagtaggtgggaagcctgggggccagctgggagttgtcactgcattgggaatctgcctcctgggcctttttattaaggcgtggagttgtgtgctgttctcttacctctggtccctgcttggaggaagaggctgaacttgtaccacctgggcaagccagtttgctgtgaccacacatggattaggtgccagatgaccacctggggaatgtgccagtcaggcagccaggatgcaaagtgattcgcttcccccttgccagtattttctagggcgtggtgtttgcccgcatcttctggtgaggcctggctatctctgaggggcagaccagcacacctgtgggtgcagcagctcacaggagtctgttgggcggcactgccaggccctcgggaccctgagtaaggtctgacgcatcagggcaggcagaggggaggccacatttcgcctgccactgatgttagcggggaggccccagacccaggtgccaggcgggcaaattgatttttcagcctgcgaaacttctaaagataggcacgggtggtgctctgtgctggcactgggagtgacaggccatctgtgagtcacagtcccgcccgctggaggagtgcaggtcctgggcaggcagcactgcggtgagaggggcccagatgcaggaggggagggctaatgcaatgagcttgagtcagccctgcttgccaggccaggatcctcctcccaggccggcaccaaggagagtgttctactgcctggctccaggaaaactgctgctgcctgtaatttatgcagtttctatggctgagtggagcagacatggcctgaatggatcattggagtggtttgtgcttccctcgccctgtggcctcacatatttaacaaaattggttgcttggtttatttcttgaatcatcacttgaaatctctcagcttcattctgaattcctcatccctcttctccccttgtttcctattttctttgaattatttggctggctctttttgatatttgtgacattatcttacatttatgcagcactttacagtttgcaaagctctttcacatacattatccaggcaacacatatttactaagctccaaggccttggaataagtgctaggctcccgggaggcagcagtgcattcgatagctacggtggctgctctcagggagacagtgataagctactgctaacttgtaggaagacaatagcgtgagatgatgctgagggtttctttgtgatggatgggaaaagcctctccgaggagaagacatttgaactcagaggaagccagccaggaggaaatttgggggaagagcgttccacgtagtagcaccagctagtgcaaaggcctggtggcaaggattagcttgcttgtttctgaaacagcaaaaacgccactctgagtggagtttagggcatgaggtggtgatggtgggggtgggggaaatgctgggtagggggaggctggcaggggccgtttttcagggctttgttggccatggtgaggagcttggatttccttctcagtattaggtgacatattggaggaatttaggcagccacgcgtgtgatctggttaacactggtgaagttcactcttgtaacagtaaggccagggagtaagggcaggagtggaagcagaagggcccctcaggccactgcacttgtcctggtgggagttaatagtggaacggtggcttggacttaaggctcaagtcggatataccgtctcagtccttactatctggaagtccaagatcatggtgttgacagggttggtttcatcacaggcctctctgcctagcttgtaggtggctgtcttctccccatgtcttcacactgtcttctcagtgtaagtctgtgccctaatctccttttcttataagggctccagttatattggatgagggcccaccctaatgacctcattttaacttaattacttctttaaagaccctgtctccaaatacagtagatgcccttatctttaggggttacattccaagaccccagtggatgcctggaactgcagatggatagtaccgatacctgtatatactgtgttttctcctacacaggcatatctgcaataaagtttaatttataaattaggtacagtgacagatgagcaacagtaatgaataataaaattgtgcaattataacaatatactgtaataaaagtcatgtgactgtgctctgtctcattacagagcacaaaaattcctcattgtactgtactgtgggtaactgaaaaaatgaaaagtgaaactatggataaggggggactgtggagtcctaattagggaaaaggagtcaggctggtgggaccaggggaaagcaagagataaagcagataagctataaatctgcctttcttcacgtccagagaatttaaacaaaagagaaaccagataagttacaggtctgcctttctttgtggcccagggcatatggcccaggatatatgacccaagacatttggccttcatgcccggataacatacataactcccgggcttcctgctcaccatcaaacacctcaatttatcaaacatccaggctgacagaggaatgcaagttaagctccctgctgccttggcattatcaatcagcccaagttccattctctaaaatctgcagcaagcttttgtcttctggaagttagcttctctcaggctaacttgcccattgtctctcaggcaacatatttccccactttctctaataaatctgcctttcttgacctatgattttcttggtaaattcttttacccctgtgccatcagcctgcattcgcccatgacagggacgactgtatagtcacatcctgaggtcagctgacagtacgcagatgagctatttaccagataagatgattaaataacagtcattaaaaagaataaccaatctttattgagcacttactagatgccaggcattccccaagcatcctgcttgctttatttctgcatcacagaaattctatgaactaggcattgccatgattttctctcccttagagataaagaggctgtggcttgggaagttttaataacttgctgtgttcacacagccaggcactgggagatctgggacttgcaaacgtgctcttttctgactccagagtccattttcttaactactatgaaatgcttcctttaagaacttgtcccagaagagaatggatgtttcaagttctgaattatacttgatttctttggcattgcagaaagtagacagatttcctgtatggtcctgtattaaacttgtatgtgaggggtttttgactgtctgcatcagtggttctcaaaatggggtccctgggtcaacagcatcagcatcacctgggaatttgttagaaatgcacattcttgggtcccagcccagagctgctgaatcagaaactgaggctggggcccaggacgctggtttaacaagccttcctggtgattctcatgctctatgaattttgagactgctgatctgcagcagccccaacatactcacaggtgtttgcatgtggaaattcaaggctcgatgtccttgaggaaccagacttccaggtttcaggtcggatgaggagtggagcagcactgctcactccatgtgttgttaatcggcgttatctccatgtgttggagatatgttatttccatgtgtttccacatggaaagtcatctccatgtgttgttaattggcgttatgccaaaaaggtgttcagtggtcaatatgtttcagaaacataggtttctccttttttatttttctaaagaagcagggcctttcttgttgctcaggctggagtgcagtggcgctgtcatagctcgctgcagccttgaattcctgggctcaagtgatcctcctgcctcaggctcccaagtagctgggactacaggcgtgtgcccccatgcccagctaattttttcttttttttttttgtagagacagggtcttgccagagaaacataggtttcttggttacagacctttcatatgttaattattattcttttgctgtttttgaagataacaatctttgtgcttcccaggcttatttgatcctgagatcctttgtttgaggagaagagaacaggactatgtttgagaaacctgcactccatagaggcttccaggagaggacataaataattgaattgggatcctcacagtgacgggtttctttcaatcagtcaattaagtggtatttactagtaggtatgctgtatttcttcctgtggcagaagctatgcacaattccagaaatgaatagggatccttatttgtcaaacactgactctatggcaagtggagtgcaagaccctacaaacttatgaacctgataccatcacccaattagcagatgagcaatctgaggtccaggaaggtgacattgcttatcttatcactgagcaactgtggagctgcgattgtaccccaggactgtgtgaatccccaaatctcttttctttcctttctatactcctgtcatcgcttggagcttgaagtggggggtaggagtggggagaaaggagcaacactcatggaaggagaaccaggcctccaagcagcagcagtgggattgtgctaattgggttatgatatcagccccataaggttgtagggtcttgcactccacttgccatagagttggtgtttgacaactaatgatccccagaatttagctgtgccttgctgagggtgggaggaggactgttagcccagcagcattgaggagtaaagtggataacatccagtgagccattccctagcacagttttaaaacataacgttaatttttgtttttcttattataaacataccacatgcttcccgaaggagattctgaaaatacataaaagcataaaaatgcatatccattaggatggctattatcaaaaaagttggaaaacaacaagtgttgacaggatgtggagaaattggaacccttgtccattgctggcgggaatgtaaaatgatgcattcactgtggaaaacagtatggcagttcctcaaaatatgacacatagaattaccatgatccagcagttccactttggggtatataaccaaaagatatgaatgcaggaaatcaaaacgatatttgcaaacccatcttcataacagcattattcacaataaccaagaggtagggccgggcatggtggctcacgcctgtaatccgagaactttgagaggctgagtcaggcagatcactgaggtcacgagttcgagactagcctggtcaacatggtcaaaccccgtctctactaaaaagacaaaaattagccaggcatggtggtgtgcacctgtaatcccagctactggaggctgaggcaggagaatcactggaagctgggaggcggaggttgcagtgagccgagattgcatcactgcactccagcctgggtgacagagtgatactctgtcaaacaacaacaacaacaacaacaacaacaacaacaacaaaacccaacaaaatgacaacaacaaaaaacagtaaccaagaggtagaatcaactgaaatgtccgttcaatgtggcatagacatacagtgattattctaccttgaaaaggaaggtaatcctgccacatgctacaacatgggtgaacacaccttgaggacattatgctaagtggaataagccagtcgcaaaaagacaaaacacaatactgtgtgattccacttatatgagatacctggagtaggcaaattcacagagacaaaaagcgaatggtggtggccagaggctggaggtggagggaatagggagatgtttttggttacagggtttcaccatgggttgatgaaaaaattctggacgtggatggtgatgatagttgcaccacaatgtgaatgtacttcgtgctatagaactagacacttagttcaataccagcctaggcaacgtagtgagatcatgcctttacaaaaagaaaaaaagagagagagagggagagagcacctctacaaaaaaaaaaaaaaagaaaagaaaaaaaaaagaaaaaggaaaagtggttccaatggtaaattttatgtgatatttattttgccacaataaaaagagcataaaagtcaaagcaggctgagtggggggactcgcgcctctaatcctggaactttgggaggccgaggcaggcagactgcttgagcctaggagtttgaaaccaccctgggtaacatgatgaaaccccatctctacaaaaattacaaaaaaaaaaaaaaaatagccaggcatggtgatgcgtatctgtagtcccagctacttaggaggttgaggtgggaggattgcttgagcccagggggttgcggttcagtgagctgagatcgtgccactgcattgccggctgggtgatacagtgataccctgtctcaaaataaaatcaaataaaaatgaaagcagcagttaaatcctagagatgattgctgttcatatttgaatgttttatgtcactcttttctctatgcatttagatgcatacataaatatcttcctgttttatcaataattctttgaagctatgcttttaaatgatgcatattagtttcccaagtagatacactgcagtttacttaaccatctccctattgttggtcctctgagttattttcagtttttcagtgtttcaggttgcactgcagtcaagaactgaatatgtccatttttatttacatcacagacttgtttctttaggacagattcctagaagcagaattgctgggccaaaggatgcacatgttttttaagattctctatacattgccaagttgctttccagaaaggtcatgcagctttcatgaaatctcaccaaaagtgtgtgagaaagtggcttttctgttagctttccttcccttttcaagagggagctcaggggatgcagagaaaaacaggaaggcagtctggtcccttcagatcttggagctgggtcatagcttgggcatgttgtctcttgggcagtaaatgggcacctcgttagagcactgggacagggctgattggcactctggccacccaggagcgtggagcctgcctgcaggaaagaacagtcagttcatggataatcccttgatattggtgctctggttctagtccagagatttttatcagggctgactgcaagttcagctctgggatggggcagtgggggtagtctgctgagctggtcagactgagcttcctgattcggtcctcaggtcatttcaagggaacacattggaaagtcatctccacgttgctcttctccattgtacgcaatacaacattttaaggaacaaacaaacagtaccttcttcctcatgaacattattctgtttaacagggagccaaacgaagttgcaagagtcctcattttcccatggtgttccatagagctgtttgtatttttaataaaaaactaataattcagaggctgcaaagcatttgtttttaaatttaaaaatgttttatagactatggaaacaaaagtttgcttcccctgcccatttgggaaacagagcactgctctcattcttaggggacagcatacacatgggtctgggatgcatggcctgctcctctggaaggaagttttgccatgggcggctggaggggcttcaaacactgagccagagagagggttaggagctgagggcttcataggaacatctgtcttttactctctctcttcatatttcaaagctctctctctctccctctctaacacacacacacacacacacacacacactctctctctctctctctctttctctctctctcggaacatctttctctctctttcttcatatttcaaagctctctctctctctctctctccctctctaacaaacacacacacacacactctctctctctctctctcggaacatctctctttccctctctctcttcatatttcaaagctctctctctctctctctctctccctctctgtctctctccctctctaacacacacacacacacacacacacacactctctctctctctctctctctctctaggaacatctctctttccctctctccatgtttcaaaactctgtctctctctaactctctctctctctttctctctctgtctctctgatagatgcatacagatttggtatttaaaaacatcaactctgactgtgttcttggtttctctctaagtataagaagccaacaaggctccttgaagattccctcttttgatattagaatgatcttgaaaggagctctaaccatacccagagtaggggggctcccttaggttgaacccctagatgtgctgcagccagtggggagatgctggaagaaacagattgaatcatggacctgcccatcagggtcatctgaggagtctcactgttggtggtttcagatcttccagaagaaactctaattagctctacacaagagccagaggggttagtcaccaaagagtgattcaccccatcactctttggtgaatttaaccaaatttaaatggtgatagggaattccttttacaattccctaagaggaaatgagagaaagagttggtctttcccaagcagcatggttttcagggacttgcttctcctggtgccttctctagtcagttgccaaatcctcgtggctcaactcttctccactgctgctgtctcttttctagttcaggcttccattgctgcttgcttggactcttgcagtactcttccagctggtctcgtgactctgtcatttctgattagtcatacatcttactacccacttaaactttctaaatgttagctaattacttcactttcctccacaaatactctttcatggctcctcattaaccaaaggaaaacaaaaagtccaaacttctcttcttggtgctcaaagatctccatcattcctccctgtgttcctgggctgcaacccacataactagtcacccctatctcctgccttatgtgggagttcattttatcttttctgctttcttgtctgtgtatcctgaaattccactcattcttcatggcctggggctaaagccaggaagcttctgtttttgatgttctaagttagaagtaacatctctctcctctaactaatgagcttccccccaaccaaagcttctaccccatttcctctctaatggcactaatcttttgtatcttctgttagggtttttggaatactagtgacatctcctagagccttgtaaagctcttatttgccttcaagtgccccccattgccagggcatggagccttgcacagggcaaatattcagcaatgttggatgaataaatgaagagtgaccaagggttgccagtggtagtcagtctttattttcaccccgcactgctatttgccctgtactcacttggactggttcctgctggtgagaaacttgctacccaggtaccacttattttaagcacatttatgcatttccaggcacgtagcaagggggcagcaggttagtgattcatgagtaggtggaaaaggtgattgccttgagagctgctgactcagccgccagccgttaaccctggtgctcctctgggccctgaatcagtgagtggatggcatgaatgaacagatggccaaggaatctcaggagacccgagtctcctggatttggactttccagcattagaggtgcacagcccagagcctcacagggaatgctagaagctgcagtataatcatggcacattttcctggagaaccagttcttcttgaaggtttgggaatgaatattattttgtattcaatcacatttgtcatgaggaggaataaaatatgcatacatattttaaaagataaaatgcaacaatttaaagaagcttcctggctggacatggtgactcatgcctgtaatacctagtgatttgggaggctgaggcaggagaattgcttgagcccaggagttcattgcatcatagtgcaatgagctatgattgcactactgcagtccagcatgggcaacagagtgagaccctgtctctaaaaatataacaaaaataaaaagataaaatttaaaatatatataaagaaactgtctgcttgtggaaggcttgcttcaaattctaatccagactccctgaggtaggaggtaaaagtttcttcttttctgccttcagggctgtcatgggaaagtttgcaaggatctgggctagtctggcacccctctcggttgctcggttccccatcactgccttcccactccatggcttctcctctgcagggtgtagactatgatgaaggttacacttgaagagcagtgaaacagaactgggttccaatcctgccagctgcacagacaccatatctggagggtgatggggcaagggacatgctcactctccctttccagaagagataaagccatatgggcaacctgctatcactgtgaaaagtgagtggaataaattgtatagtgagtgaagtgtaagctcatggcggcagtgtaagaaacacattcttgccaggcaggcagataaccaagaaaggacaattgggaacacgtcagctgatggagatgctacccaattgtatccctatgtggagagaccctccagcaccatatcccagccacctgcgccctgccccccattggaccccctcttcactgtttgccaagctgaacattggacatgtcacatgttccctccctcagtgcctgacttactaaacagaaaatgcccagtgaaaacttaggtaagatgtcgcacagtgtttggcacttgataccttgttgctaatatggtggggaccccttccagcactgaaaaatcccgcagcacttgtggcagctcaaacagagaatgtaccagtcactggctcccctgagtttcttcagaaattgtttaaggagtgctggatccatgagggcagaggcttgtcccagtcactacactgtctctacctgctggaacaggtgcttagtatgtacgcctgctctgtgctgggcccatgactgcacaaggacagctgacttcagaggattgctcaggatcactgagaaattcatttggcaaaatattgtgaatttaatggcctcttcaatttgaaataaagccacccggctttttgaaatagagcttcctttgggagcttagaactaaattcttggcttcatagaatgccctagctgggtggacggagaatcccaacatatagatgtatctagaatgtcagaagtgaagtgatctgtctctccaaatcattggtgctagggagaaagaggtgagcatgctgtctttttaaaggattcaactaactctcagagctttggaagaaagaaaaaaaatccaaaatgtgtactaggtcagtttttatttggaagatggattttattgttatatttttaaactaggaagtctcttaccactcccattctccttccctggcctagaggggtgggagttcagatccctgcaacattttaacccaaaaagctcttacctgtttacctttctttgatagagttgccaagtggtcttggttttgttttgtttttcttttagaagagaggatctagctatgttgcctaggcttgtctcaaactcctgggctcaagcggtcctccagcttcagcctctcaagcagctaggattacaggcatgtgccgccacactcagctcaccgagcggtcttgaacaaaaaacccaaattggtccaagtatggattatacactaatgatatttatcaccatcactatcgttgtcattatcagttttattatagtgacttccagttcggtatctattgtgggtgcttggagcttttgcacatgtaatcttatttaatcctcacaccaacctaggaggaaggtattattattattgcccttttccaggtgggaaaattgaggctcggagagttgtaagtggcttgcctgatgacaaagggtgggtgagtggtagaggcaaatttgaactcagtgaagaaagagttcaggctttgctgtcagatggactgaagttcttctcttggtgtccatgggggtgccagagatgtgggggttcttctttctccttccaaatcagacgcaactgaaagtctgaggactcagcttcaatctgagctctgatttctctagagtatccaggatggaaaaggggatggtaagatgaagtttgcagggagggcttcctggaggagagggctctgaaacatgagagcattcgggcaaataggaagggcaggtattttggtggatccagaggcaggtggattcagaggtgggtggctcaagagtacgggcctccgtctcctcgtcttcctaagcatatttaactgtgaatgaagcaagacaagaggtgtatttctccatgtaagggaaatgctatgaagaaaaggcatttctggtgtcagaatcacgattgtcagtgggagtgtcaggaagaaacttcgtgactttttctctcttcccaggcgcccccagctgttaggtttcatggcaacccaatgtggtagaaggcagtttcttttccattcttgctgttagatttttatgttgtgtgaccttggggctgccttagggcctctctgtccttcatgggtctcacctggcagaggagggggatacacagggtgatttccatagggacttacagctctaaaatgctcgagtgtatgatctaatcatgatgacacacagtcagccacagtgaaatccctgacacatctcaaatttgaactgcatctttatgagtggaaaaactgtttcctgccccacaggacattttgatttaactaggacacacctgaccctggtctgctcacagacagagagaatttgttctgtggcccaaggcctctgcctgcccctgctcccaccccaccatgggtagcagtggccacgtggtacttgaggacagcatcctggaacttgcccaggagtccgctgcatgctggctttctctcttctgcagagacgaggggcccagatcgggtcagcctctgctcagctctgcagtcttgccagggggaggaggaatcaggctggggggcagggatagagggccgtgtgcatcagggaaggaggccctgagatgacaagctccatgagtcactcaactggccgctccagccagagagcatcaaggaggggtttatgacactgcctcatgcagcagtgatcagccatgaggtggcatccatccattgtcaggggacagtccatcctcctcaggcacatgcacagaggattgggtgcagaggagttcaccctcaacacctctgggtgttgggaggcaggagagcagtggggctggaggcacagctctgccaagcattcctgaaccaaagcaagccatcaatgagtgctcacaccgtgcaggcactgtgagcctgtgtccacatgatctcatcttgtcctcagggccatgccaagaggaggcactattcttcttcttctcagtttatggatgatgataatggaggcatagagaggttaagcaacttgtttgatgtcacccaacaatgctgaaatggggcaggatttggccctggccctccagagcctatgggcttaattgttgccttggtgggtcttagccttgagcctgcattagaacaacctggagggcttggccccactccagagtttctgatttcggtcaggtctgcgataggtctgagaatgtgtgtttttaataagtttccatttgaggtaaagcccagggaccacactagtctgtgctgtactgactcatcatcccgtctcagtttccaacctccaaaaccagagggttgagctttctaccagttctctccagttgaccagttaacgcagaaattccagccttctaatcacccataattatgtttagttttggacaacttaatatatgagagagcaatagtacttcagtaaactcctctactgctactgggtttctgtcacttgtctcctcttatttttgacaatttgatgttttgtgttgtgaggcttcctttgtgcctaaaagtcattgacttttagatactcactttggattatctccatcaatgtgaaacctcctgtgttgccttatttaatgtcttttgccttgaatttcacttgcttggataccattgcctttaacttggcatcactccttagcttgctttttacagtttggtagagatggtgtctcactatattgccctggctggtttcaaactcctggcctcaagtgatcctgccacctcggcctcccaaagcagtgggattacaggtgtgagcctcacttgatttttgcctggcatattctggtttattcttttacttttaaccttattttgtcacttggtttagggtatatttcttataaacagtgtataattttatatatttatttattatatattattgcatatagttaatactatatataatgtgtaccacacattttgattgtaataactaatatgttttggcctttctgttttttaaaaaatgctttttgcagtcttttttgtctatctgtaatagatatttaaattttttattttatacttttctttattaaattggaatgtctacccatgctgcctctcaagtatttaaaactattgttcaaccatattttgccaatggttaatgtatagagtgaaatagcctcttactccttgccacgtaagataaataatttttcttcttttcattcccccattccataatattacactcatgcttttatggtataatctgatatttaaaacttctacttattattattatatttttcacattttatcttctcttccaataaattttagttttcattttcattttgatttgtaatcacagttgtaacaattatttaaacctaatagatcttagggttcattgccagatctttattaccatggacatctcctgttgttgaattccttgttttgattaatgtcttaattacaaatatgaaaaatttaacacctgtttaatcttcttgaacaacgtattctgctttatcgcactttgcactttgtttcttttaatatgaatgacaacttggccctgctgttgggttttgcagaggagacatcagatatcagcttgatttttctctttttttttcatagataatctgatatcttctgtttggatgctgataattcttcaccatgaaattaaaatatatgtatgtatgtgtatatatatatgtgtgtgtgtgtgtgtgtgtatgtgtgtgtgtgtatatatatatatatatatacatgcctactgagcattttgactttcagacttgggtctgtcttctgtgttaagaaacttttttttgttttcgtcttttcagttaggtttattctgaattggctgcctgtcctctatatctgtcatctttttgtataatctgtcttagacctcacagtatttctgcttctgtatttttttcctcttcattttgagagtgctttctaaatgtgcccttcataacacatcttgtttcagaaataagttctcttgacttttactgcagacatagaatagatggtttctccaagttcaattatcacaatatcacacgagttgtttactgagcacagactgtcctctgtgcactgtgctaagcactttgtgtgcattacctcagaacaactccaaggggcatgtgctttgtttgtcctcattatatagattggggaaacgcatgtccagagggttgagccctactcagcctcatctgggtactgactgggggccaggactcaggtccagccagtttcacagcagagcctgtgctcttggccatgatgataatggcactttcccacccagtccttttttttttcaaatttatttattttgagtgctgcattctctaccttttatagttaagaatgttttcaaggtctggtgggaggttttcgtgttttgcatccatgaatgcagtcagtgtttgcctgtaaatagggagggtcaattctcttgggctcctctgctgtgcacctcattgcccatagaatgctactctcggatcttgcactagagcactggatgatgaagtgaagccttgcagagacctgtgagtctgggtgagtgagctggaaccatgaatagttccagaaggggaacttaatcctgtgatatttcttctctgtgtttggtaaagccactgcaccttgtgccaactgtttgcatctggcttgctgtttaacctggccaacatgccaggtacaaactgtgcttggacttgtcctccttcctggagctgccacctgctgtgtcagggacaagcccctgccctggccagttttcttctggatgtatctgccatgtgattcccagggcttctcagagctgctgctgctgctgaacactgctgtgatccatagtgaccagggagtcccggtgcctgatacttggctcacctccctgttcagccctactgatgtaggcagctctgatgtgaggttcttcaagggcctcactccttgtttcacaaccatcctgccgcttctcagggagcaaagctgcccaaggggcctccctgccttctctttttctgcataactgatttttttttttcagattcctttaggtttttggcacattgatggcacctgttcctagtttgctgagctgtggcaggttttccaggcatactggatttgttttgattttgaagcaggaatctgggcaggagggcattgcatgcctgagctcttgttgccatggtatttgtaaatggacaaatgtaaatgaagccagtggcagcatccttctccctccactgcccatgctcctgagtgtgggaattgggggacaagtcactacttcttcctgacttctcctttactcacctgcaagttagccacatcttccactttctcccttattccccacctcaaatacaaagtcctaggagaagaggactgggagcactggatttgatattgaattggagaagaccattacaacctcagattctaagattctgtgatagcatctgtcctggtgatctaagtcgggttaaactcagctctcttttaggagatcaagaggttttataatataggttgggtcccctgccagttcttcttacatatcacacagtcttagtttggggacacagtttttggaagcctgtctgcgggggttctggaactcaggggtggatgcaagaaagcagcattggttctttgtcacgaggtgagagcaacagtgtcaggaatagactctgtgagctcacccaccctcaaggggcatcgacttccagtgcatcactttcaagttcatctgtgtctggccataggcttggtcacatgctgaggtttagtgcatgaaccatcatgtctactgaggtacctgacactccagaggcattcaatatgttatgcaaatggccttcatgcccaggctaattagggagtccccattggactttgattattcataaaagacagttgataataaagccctggctgcttttgaaaattcatcaagtaagaatgcagggtttttccagtgggagctcagacaaaaagccagtggaaggacacaataggatcagtgctgaactcccatggttagttcgctctctgagatgcatgcacagacctctgcagaggccttgggcaacactggtccttttgttcgcctgggtccttttgtttgcctggtcagcagagtagagggtggtgtcctagtgaggacaaaggattcaggaagagcaaggtagtgtgggtaggggctggtaaggatggcgagtgggaagacaatgagcagagctttggagagcagagtttgaagtacttgtgggacaccaggtgaagacagccaggtgacagcaggagccaggtgtcctcaggctcttgctagtgctgtgtcctggtcaacacacttaatctagctgaacttcagttaccttacctgtatgtaaaatgaggatgttcatagctccctcacagtgatgttgagaaatcaagtaggtaaacaaacatggtatatagctttgggggcccactggtctgacagggcgctcaacctgtcctctttttttttttttttttttttttttttgagacagtgtctcgctctgtcacccaggctgcagtgcagtggcgcaatcttggctcactgcaagctttgcctcccgggttcacgccattctcctgcctcagtctcccaagtagatgggactacaggcgcccgccaccacacctggctaatttttttgtatttttagtagagacggggtttcaccatgttagccagtatggtctcgatctcctgaccttgtgatatgcccatctcggcctcccaaagtgctgggattacaggcgtgagccaccgtgcccggccctgtcctctctttcttgaatggtgctccttctagagcattccttgtaacatgcatgaggtggtctcttatcttgaagacccgcacctggtgaggagggtgacagacaggattctgttgtcaaggaggtggtaggaatggagtccagggtgctgctaagggagggccaggctgtatggtcaggtgggcacagctgcatggaggatgcttcaggggctctggagaagaaatgagtgacagagctttcaaggaccaccttctaggggtggggcttccaggcctccaaggagggctctgtgtctttatcagaccgatggctgcccagaacctttggcagaggggctcagcctgccttggtgccagtgagcttccacacaggaagacttcctgaggctggtggctttccatgagcaactacagggaggaaccgcgggggtactggtggctcagtagcctctgcttcctctgagggaatggaggggtcagtccctggtgtgggggtctcttccctgtcctctgctcatcatgaggctggctttcctcttttgcccaccccttgggctgggaccagagcacagccagtcaccagtatggtggcccagcacggcaggctgtgcctgtctgtgtacacgccagctccatgaggtggaagctttggcaatgggctcccagggagcttccccgcaggcttctcaggggaatgtgttgggagtagatgcatggagagttcgttttttctccctttcatgaatgagaaaacgggcagagaaatcacggcactcattggccgatgtttctgttggtgcagattaccaagggtgctgaagtcaaaaggagtgagccacagtcagccctctgggtggttgactgccactggggcctttagaccaggaaggtgtcgtgaccgaggtggacctggtggtgagatgcaaggtgtggcagcctgatgcggaggtagcagaagggagacaggccaagtcagggcagccggcaaggggcccatcacagagcagtgcaggcgggaggccacaaaggcctgggctggggtaacgtgggggctggaaccgggaagctccttcacacattgagcctacttcttgggactctgttccagtatattagtaatgttaggaatttcagtttggctttttaaaaagctgtttttcctttgaggaactcaaatattattggttgaattgtgtctccccaacagataatgaagtcctagccctccgtacctgtgaatgtgaccttatttggaaataaggtctttgcagatgatcaagttaagatgagatcattagcgtgggctctaacccaaaataactggtgtcatatttataaaaaggggaactttggacacagagacagacatgcacacagggagaatgcctataaagatgaaggcagagattgcggtgatgaatctgtaagccaaggaaggacaagaaaactaggagagaggcctggaacacatgtgccctcacagccctcagaaggaactgaccccaacgacatctccatgtcagacttctggcctccagacctgtgagacaatgcatttctattatttaatccaactcagtttttgatactttatgatggcagccccagcagacgaattcaccaagcttcccggatcccatttcttcactctctggaaaactgctccctctggtgtctgagaatcacacgtatgacctccctgaggggctcagggttggcaaggcctccccatctgggtggtgaaaggtgctctctgggctgcaaagaatccagacagctctgtgagcagcggctgccaattcactgacattgactgactctggggactctacccttttcatccccatgtgcccgtttgtccagcccctgcagaaacccctgtggggtctggcagtaagcgaggctgctgttccagggaatgtgtgtgctgaggctagccaggcagctgggctagcctcctcctgcacagtccttcttaggaatgtcctaagtacctattcagccctggcctgaagcaaaggaggcactgggtaatgaggactgggaccccattgctcatggtccaattggcgaaatgccagactaagcacagatcacttttcaaagtcaaaggcaacgtggtgagtttctttggcattaaaagtcctctcccatggttatcccattctgagtagccagttgtgtatttattcacccagccctgtgttgcggttattgtcttttgagtgtttgattctatcccctttatatgactcatcagcccccagaaagcaaaggccctgtcttgttcagcctggcacaggggcagccgaaattcccacagggctcacctccttcgcctctgcctgagatgtcttatcagcgtcactctcattctgcaggggaggaaaccaagactccagggtggagtgattggctgtatgtttcacctgcagccacgcgaggcccagaagtcttccagtgctttggaggttcacaagaaatatggtgactcaactggaaccacattagaggtcagcatttaacaggtcccctcaattttcccacaagggccagtcttgtgtcctcggctatgaccatgagccactggggaaagagatgctctcttccctgcagctgcacggctccccgtgctgggttggccacacactccccacccagtgcacctccgttgattgattgacgtggtgttaaacatgtggccttttgcaggcaactctaggagggtgatgagctttgcaaatctgcccagtgcctaaaactgaaccacacacataattcactcacacgcactcgctcagttgggcttgcattctcactgccatcctgcctccaactcacgcttgacgcctcacagttctggacttctcttctaccacacagcagtgcctgccctggctggccagtactacattcctgacctttgggttttgggtccctgggggcagcttgctgccatccgaaccaccaggccctggccctcagcgaggcttctccaagtgttctgctgccttacttctgctttcgaagcaccatgcctgtcctggggtggagtcagaagtcagaagaagaggctgattagccggggtgcccttggaggggccagggtctcctgatctgcagccagggctctgcatttaggaagccttgtcagaagcctgcaattggcattgaatctgtttagagtgctcaacctagtgccaggaactgtgggaaatctgaagacatgatcagtttccagagagtcaagacaaccagcagaggattcaggttaataaacttagacttgtgttcagctacctggttcaaatccccattcactggctttgaccacaggagaatgatttcacttctctaagcttaatttctttgtaaaatttcacaaggtattatgagcattaaatatgataatacatgcagaatgctttagtacattgcataacacattgtaggcactaatacatcttaccttacaatactctggcctctcctctccactcccatacaagcgaggactcttagacagtgcctgtcatgtgccagacatctgtaaagggatcatataagcattaactcatttaatctttacaggaactcagggaaagactgaggcacagactgaggaacttgtccatggttccaaggtgcagaaccagggttagacctagaccgtgaggctcttgcatctgtagtcttgcttagagcactacttgcaaagaagccttgggtaacttccctatacctccatttcatcatctcgaaaatctagatgatgatgataccagctaggatcctcaggaaagttccctgaacttcattaagggcttagaatgatgcctggtgcatcctcagtacagagtaaatgcagtggcttcaataagaaatacaagtacacaggtggccaacaattcaagctattagatgcagaaggccaaggaggtgatccagctctttcattatggggaatcagagcatgcagatcagcaggggctgggttatgagagatgaggagtgggctgatccaaatgagaggtcagcttgagcagaggggaggatgtgggaaggcagagagtgtggaagccatgtgttgggagcagggtctgagaacatcaggttggggacagcccacgagggaccttcattagcagtgtggattttcacctgcactctgtcggcaagcactgaaggttgtcattagcacactggctgtcacagaccagaggggcttcccattcagtcaaatcttgctgcccatccccagtgaacggagcagtaggcagtgaggcgggaccggcagggcgtacaagatgctcgcccattccctccatttgaattgggcttgggacatcccaaggggctgctgcctgggccctgaacacatctaagggctatgggtttatggtctttcagctgctgtttatgtcacaaatgcctgtcacagaaggggcattaaaaataaccgaatggctaataccatttctcaaaataactacttgcaaagtgctttgctggggcgaatggctactaaaattagactccctggtggtatatgtagggtgtgtgtgtgtgtgtgtgtgtgtgtatgacttctaaacccatttccccccagggtgaggcccacagtttgcacccttttgttctgtggccccttctgtcatagctgggtgtcccagaacagtgttcacccagtcaccccaagatgccctctttcatcctgcagtcctcagcaaattggagccactgccctacattgccctgttgtcctgctctaaggagcagaattttgaagaatcttggagggcggggtggcctcattgtagcagtggcctaattccttggtgtgccaggtaataatagcacgccgtggggggaatctcactcagcatgctgtccgaggggaaactgggccatggaacaatgtggcagccccactcaaggtgacctagtaactgagggcacggacacacgattttccaggccccagttccagatccaggctctagaactcttcagtggtctcctgggccagtcctttgggccaccaggcaaccaggtcactcaaatccaatcaactctccatccactaataatacaaaaggaaatgtgggatcttaagagcaagttaagaaaacaaagtgaatcagcactgtgggggattttggattcaggacaaacaaaacctgagagccagcgttggttttcttttagataatgacttgcacggaaagaggtggacctcagtgtctccatctttgaaatgggggaacactgagttatttagcaaccatttattgagggagtgcctgatgtgggcctggctcctacagtagggctgattagggctcctacagtaggccctggagttacaaagagtggttcaaggtaaaagcaaggtcaagatacatttacaagccagtgtgttgtctgtacgtggcagccctataaggactggggttctgtgtggtcctagagatttcggtcctggagatgaaagactgtgagtatttacctggaatggaggcccagggaggaatgaatttccctactcctgtgagagctgtatgtaaatagactgtttctgtgttggaaagagcacaggcagagtctgtgactttaggcaaactgcctaatttcttttcaactgctaaatgtgaataagcacagcaccaacctcctaggtctattgtgaagattaaatgacataacctagtgtggtcttagcgtgttgtaggcactctacacactctatcgttagtagtagtcatattaatattaaactagcaaaaactgtttgcccaagaagttccagtaaatcattcccttcaatcagggtgatgataattttattttttagtattattaagtcattgctgtctgtaaggccatcaaagagctggagccacttgctggaatcaggctaggtcaatttctgaatgctggaatgaggttgaggggagtgaggtagaggatacatttttaaaaagtttacatgtaatcaaaccctggtcattcacatctcctgttagattcattatgggagttggatatttaagaggaatctttgccacaaattcatgtgtaaacccaataattctcgactgttaaaagtggtgggagccctagatattaggatatagggtcatttaaccccgtggttctcaaccaggcatgattttgcctcccatgagacattggcaaattggggtgggtgctgctggcatccggtgcgtagcggccagggacactgctcatcttataatacacaggataaccctcctcaataaagagtaatctggaccaaaatgtcaacagtgccggggttgagaaactctgtcctaacctgaagatgagacaactgaccaccaggaagggggagtgacttgctgaggttaggcagcacagctgcaccagagctgggatccaaagtttgaatcaattgaccagaggccagaggccagacagaaccttgatactgtcatctcacctgtgaagtaaattatcaacctcacccatgtgaatgaggccttactctatagtattttcaaggctctttctcttgtgatattaagctctgctttggaaaaaccaggttttcctattctgggcttgctgatagagtaaggatggtagattcagcaaatgaaaataaggttgtccaggccaggcgcggtggctcacgcctgtaatcccagcactttgggaggctgaggcaggcggatcacctgaggtcaggagttcgaggtcaacctggtcaatgtggtgaaaccctgtctctactaaaaatacaaacaaaattagccgggtatggtagcgggtgcctgtaattccagctaccagggagactaaggcaggagaattgcttgaacctgggaggcagaggttgcagtcagccaagatcgtgccactccactccagcctgggcgacaagagtgagactccatctcaaaaaaaataaataaataataaaaaataaataaataaaaagaaaataaggttgtccagttacatttgaatttcagataagcaagataggtttttggtttttagtttttagtttaagtatgccctatgcaatatttgagacatacttatgctaaaaaattatttcttgtttattctgaatttcaaatgtaactggcaccctatcttttgtctgtcagccctgtgagctctacccatcgccctgagatcacaggtaggccctggggtcatctacccctgtctgaggctcctgcaacccttatgaccccctctgcctagagggggaagatgggaaggggcaggtgggccttgagtggagcaggcattcctagctcctggcctgtgggtgcctgggaagagccggctagccacactgggctaaagggcctgtaagttgagaggttggccaaactgtccctttttataacaggagaatggtttaaatgaagtgtcagcaggtgacctatggccctggaaaaccaagtctggagaagttgtggcaactttgcccctgattggggaacagagtgtcctctgcacttctactggtttccagagaacatggctgccctggctgaggagcacttggacatggtaccttccagggctgaggtgctgtctcctcgtcacccctgggctctgggcctgccccaggggccagagttgggcggttgttcctaatacagggggaaatgatgggcagggctgtgcacccacagagctgctgctgagccggcagctcagcctttttgtttagaagaggcctagatgtggagcctatcaacagatcagaaggggatgctggctcagctgctccctcaccttgccttatcccacacccctttcacctttgcttccttaccagcccagacaccaggctccaaaccagtcagtgctcagggtccggcagccaatggcacaaggtgggtggcccactgccctgccccattccctccgcctcccaatccatggtccaggctgttgctcccaggtgtcaggatgccatcccccttccccagagcagcttcctgctaggaaatctcatcctcacagctcctcctaaagggcagtcagctggccacagccacaacttggtggcctttcttcctgttggctcagaacagcctttgagggtctttgggagtaactgcttagggactcaccatgttgtctgccatcttgtcgacatcgttgggccacctaatgaccagggctggctccacctggcctttgctgcatgggtgcttattaataggcatatattgaatgaatatatgcctatattcacagagttgaggacagttaacccatattgcagaaggtgtctgatgataaaggctgaatgaagtcattggttctcaaacttgagtgggcattagcatcacctggatggccttgttaaaacgcacagtaccagcccaacctggggactcctgactttgtagttctggggtagggacaactttgcatttcttacacatccccaggtgatgttgcaggtccagggccatctctgaggaccactggcttaagctggtgcccttctcaaaatgtcttgcatttccattttacttttattaaaatattccttaattaacaatttttaaaaatcttcattgactacttactctgtcccatgcacgaaattttggggataaaaagagaaaaattgcctcaaggaactcacagtacagtgagagaattgcccatgacaaacaatgaccatttaatctaattacttttattgggatattgtgttgaaggtgcaatgggggtgtggtaaggggaatgtgcagtgttgttgggggtatccctttgagggcaagtgtgatagtgtctctctctctcttttgtattgcacttctctctctttctgtgtattgcaccaaaagtatatactttttgaagaagtatacacttctttttgtgtattacacttctgtgtggcttgttttccccagttgacttgcgagatttctaaggggagaggctgaggtgaatcttggtcttcttcatttaagtgtgttccagttgacataccaggcaaccaaaaaaaaatgtattacctacagaaaagaagttcatatcaaagaagtgaatgcctaatggtggaatttcagggccaagtctgtgtgggggtttactcatctagattctactatatgtgttgagttctagggctgagctggatggagagaaagttaggcaggacggtacctttcctggttcctaccatcaacatcgctgactgagtttatggggaacactgctggtatttcatcctgcagggattcttgaaacctgccatgagctaagacagctcattttcaagagctttaagtggtcctgagcggatgcttagctggggacttgtcatggcctgaggtgacataccctttctgcagagggagaaggcctctgaacctttctttcttcagaacctgggggactagggaggaagggaaacccctccatgacttgcctgcttggggctaggagctggaaatggagacagaggaagctgcttcttattatgcacagggccaggagaaacccttgggctttgcccggggccagggctggcttccctgtgactttctctccacacaccctctcatcctccctggcttcaggagtgacagatagaagcagaactaagccggctgtacccatcattaataacagaaatattcaggatagctcattctcatggagagctcactgttctttgaaaataccttagattcacgaacagattgaaaagggtcaagagaggttaagaacagccaatatttatagagcttgtgctctcagccacaatttcaaagtgttctgtgtgcattacttcattgaatctttagaacaaccctggaaagtggggtataattggctccattttaaagaaaacaatacctcagctatgcagtttgagtaatggtcccgagatcactccaaaaggaaaagtgtagcaccagatttggaatcaaacaggaagactccagagcctaagttcattctctgcggtcctgctctacttggtggtggggaaggggagggaggagatgaggtgaggttgaggaaagaatacttcagtgtgtgcttaatctgcctcctcctgcaccctgccctcctcctgaaggtctgtcctggccacggcagcctacattatgtcctctttccagcttctgttttgacctggtattgacatttgacttggcatggcttatcattatctctatcttgttaggattgcaacaccctagtgagcagggaatggcctccagctccctcaggctctcctaggataccttacagcagaggtcagggtagggctgataaacacttatagttgcccagagcccggtacctggtccacagctagggtgaccaaacattctagtgtgtttcagttttggcactaaactctggcattctgggaggccccacaatactggttggtcaccctatatctcatttgacaagcaaggacattggtccttgggggacacagtgtggtcccagtctcacccatggttattggtggaggctgatcccaaggcctgctctctgaccctgatccagttccctctcctcctgctgctttagaagtgagggctcagtctcctgctcttgcttgttaggtcaaaagcttttagagacagccactgtcttctctatgggctctgagatgcttcttattctcttttggagaaaagacccccacagtcaagaagctttggctgagccatccttacttacagagcttgtgctgggcaagtcttggagggtcagcctgtgttctctaggggcttgctaacagaaaggaaacggcttttcctcgaaccacagagcacagcaactcttcagacacgctcggtcagcctgcaggggcagggggtggttgccaaattctaatgatcagaaattagaaacgggaacagtgaattctagaccagcagcctccaaagtgggatgcacaaaactatcctttggaataggggaagaaaatgttaagacatctatttctatttacgtttatcactctttaaaatgattacatctgtgtgcactttattgcgtatgtaatatgagcaccatatggtgcatgatgggcatacaaatacacacgtgggagtggacactgatgggggttgctcattcagaagtgctccctatgtctccacagctgtattttaatgatcatgaggtgggctggctggaagatggtcactttcagcagaggaggttcagaagaaggagagagtgagtcttagagtaaattggcttagaacatcccttagttgatgtttaatgcagatgatgcttaagtgtttctggatggtgtgtgatttcttggagcgattttgtgcatcaggaagtgaacttcctgcagccacattttgcacatcttgttccattacttgtctaacaggatgctcacattagcttgtgggtgacaagaggcaggctagacagagcagaggttctcaaagtggagttttcatatcagcagtaagagcctcacttgggaagttgttggcgatgcagattcttaggcttgctttcagccccactgacttagcgactctttgggtggggcccagcatgtcttgtttggaccatttgtccaggtgatgctgatgataggcaagattgagaaccatggagatacacaggcaggggcacacagtttgaatcctggttctgctcctgctgcttctgtggcctgggacaagtgactgatggcccagagccttgatttccccatctgacaaatgagagtgataacacctctctcctggcattagtatgaggattaaaataggagacaactgatgtaaagtgcttagcactgtgcagagcacaaggagttactgcatatctagcctcagttgtgatttttaccattaattggattatgatgggggacggcaacttctataaggaggtggcacagaaatgtctgatttctccttccttctttcagtagctctgtgaccttgggcacatcattttccttgcctataagatgtagataacgacacccacgtaacgggataagtgaatggaggtgcctgcagtgctttgcactttgtaaaacaccaactgaataggagaagtttctagagagctctttactgaggctgcttctactttgtcctttctggaaaatacttcccctctgcccaaatagtaaatgagagaggagaaaaaagccagaaatcccacggtgccagacttgcaggcacaaagagcctttgcaccgtaggtgactttgtttcctgagtgccatttttggcccctcccaccctggtcctcctagatcctggcctcagcttacttcccctgtggttccatgttgattccttattaaaatgtcacctgcaagtcatgaaaactcagtgtggtttcctgaaagaggaggggcagtgattgtccagagtgttcttttgtcacgatgagaattgcttgggcgacagtgtcaagacagcaaataaattgcctcctccccttcaatgtctcagtgctgtttttgcagcatgaatggttccagtgtggagataatccttgctcatcttttcaccaggttcttgaatgtggaaaatgggcaaacagttctccctcaccacacactcctgttatttccagtgtcccgtggccatacacccatcagcagagaggcctggagtggcaagcaggggtggctggaagtctgctctcttctcatgagagtactgagggcccagtgaggtgtctgtagagcaagatagagccaggtgatcggggaagagagccctccaccccagttttcccaggaggcgacaggccccatctctggggggagtggcgcatgcctttctcctcgtcacctgccccgatgagccccacatggatgaagtgagagcctgtgtcaccaccccggctcctcaggaggctggtgatgaatagggatggcaggaaaaaggagctgggctctgctgtgacatgtctctatttttccagaaaactgccggatgtccttcccttgtaaaagttgaagagaacagaggagaggagaagggtcggagcagagagatttctgatatgctgttagtggcgctgccaattaaaaagaaattaaaacagaaatctccgtgggctgctggagtgaaaaagtctcctctcctggcccctctaaacccttgaacaaattaattggttggatgttgactgggtaccagtgaaattcttagatattaggtcttgttctatggtaggcacagaagaacaaggggtgtgtgtgtgtgtgtgtgtgtgtgtgtgtgtgtgtggtatgtgagagagagagagagaagagaggaaggatgggggagagaagaagggaaggagggagaaagggaaggaggaaaggagggaaggagagcaagagagagacttgggggcatcggggtgggttggagcagttcagggattgaaatcatgctgcatgacatttgggcattttggggtagctgagacaaaaactgctggaatttcattttgaagataagaaaaggactaggaaagagagcttctttaggccagaggagaacagattgaggctgtgaaggactcttggctcccagctcttcttgttctctgtggactttcaagcttctgcagggagacagtgaactgggaggaatatgtagtgactgtgaaggttacatgtggctggaaggggcaggcaaaaggtcccaaatggccctgtggtgctttagttggcagagagatggacaagttgatcctgcccttatgccgtctcatgcatttgtccaaaagctttgtttctgctgcgtggtcagagacagaaggaggaggctgcctccccttcctgggacctggatgttttggttcatctgggttcctttctgattttgtgatgccctaagcctcctgtccccacagcccttctttcctttttgtagattctcttgcaaacttacaaagcgtctgtaacctttggccctgggacccagcatgagcagcttactggagtcaggacagatgcacgtgggtgctgagcagagccctgtggagcctcggcctctggcctccttggccagctgctgccctgtcccagggacagtgtggcttcccagggagcacttcactccaatctctgagccataaaaaattaaactacagggctatcaaatatttaatctgcctgaataatgaacatgggcagattcttatgaattctttgctttgattaaataaaattgaaggatgggaactgtctgcttggcacgttagctgaaggcaatgcagggtaggcactttgtgccagggatctggccctgagtctggaagaaccatttggttcatgtttcctcacccactgtctatacttcagttgtggatagccctctggtctttattcttcttacctgtaaaatggggataataatgataatactacctcacttacaagattaactatgagatttatatcaaaagcctagtacctggcacctgttagtttctttcttttttttttttttgagacagagtttctctctgttgcccaggctacagtgcagtggtgcgatctcggctcactgcaagctctgcctccagggttcacgccattctcctgtctcagcctcccaagtagctgggactacaggggcctgccaccatgcccagctaatttttctatatttttagtagagatgggctttcaccgtgttcaccaggatggtctcgatctcctgaccttgtgatccgcccgtctcggcctcccaaagtgctgggattataggcgtgagccatcgtgcctggccaggcacctgttagtttctaaacaattgttaatatcattcattactttatttctaaaacagcatgattgaattgagcatttccttggacttggaaaggtatgattttggaggagggtgaacctgtgtaggctgttgcagggagttccttgacattatcaactgaccagtccatcaacaaatttatttgttcatttatttattaattcaaggatgttgggtccatttttcagttagactctggaaagataagtgattggtcctatcccttaagggaaatatgctttcattggagaaataacatgtacacgctgtgtgtatgtgtgtgtgtgcacgcgtgtgtatgtgcatacacatgtgtatcttttttttttttttgagatggagtctcactctgttgcccaggctggagtgcagtggcatgatctcagctcactggaacctcccccttccaggttcgagattctcctgccttagcctcccaagtagctgggattacaggcgcccgccactacctccggctattttttttttttttttgtatttttagtagagacaggatttcaccatgttggccaggctggtctcgaactcctgacctcaggtgatctgcccacctccgcctcccaaagtgctgggattacaggtgtgagccaccgtgcccggctgcacgtgtgtgtctttatgtgttcaccctatggggagagaaaaggttcatgaaagttgagattactgtgggtagggttgtcagggagggctttgccgggagggggaagctgcgctaggcaagctgtggctccagagtcttggaggcgcctgtaacagtccctgcggtttcaaaagaattcagagaggggagccatagcctggtctccaaatgtgcagcaccttctgggcaagcttagacttaaaggatatcattgtagataatgatttgcttatttcttgctctaggatatggggactgtttctttttttctgggatgctttaataggatagtaaaagtaaacgtgtccctgtctgatggcccttggctcagctggaagaagatcagctctgctgcaatttaggaagagataactggggtccatcacgtggctggttcagaccagggttttatgactgggatttgcctgctggagccctgggtcactgtgccagactcaaccacaggtcacaatctggaactggatccttgctgccagatgggaggcgggcagggccagccctatgctgtcattggcctgtagccagctcaggtctggtggcaagtgaaggacacatcctgatgtctgagtgccctgcaatttattggcttgtggtttaggggtgtgggggacaaacaccaatgccacagttgacatatatgggcgtcgtatttggtggggtcaagagtccggagggaggcgcatccagcttctgtcttggctgcaggccaggtctgcccatgagacggttctcctccttaacctattcaatccaataatcgatgagcaggtattttctgagatctgaagtgtcaagtactgaagacatcaccaggcttggctccgtgggacacacaaggaattataaagcaggaccccctcatccccctcaggagctaacagtccaattgagggaagcaagagagacagacgcacgtgaaaggttaaacaacttgtcctagcctgaaagacaagacccgtgggaaacaattcaggaaatgtcaccaggcagcatcttcttagtgctgcaaagatctggaggaacgaatgaccagccggggcacaggggtgagggcttaggcttctggggtccggttacaaactgtgacaccttggccacctgggtttacctgtgtgagtcctggtctctatatccctcagatgggcacagtaagacctgcctcagagacatggggaggatttaatgggacaatgtgtatagcacattgcctgacgaaggggaaaaacctcactgtgatagttaatttattgtcattggctgcaggggccagagagtctttggggaggctctgcgggtaaaggctgagcctagccttgtattgctcatcttttggataaggtaaggatggaacctttgtgaagaggaagactggacacctcctgccccctcccactgtggtttgagtggattttatcccgcatctgttgtttgcctggcattggatggccctccacaccagagagctaatgcctgccttcatcactagtgtctctgtctctttgtttcatcagcttctttatgtgaaaagagagaaatgatctctgtctctttccaaatcccagcaaggctgaataatatctgtggatattcttttctatttcttaataccctcgcattgcttatgaaaatcctatgggcacattgtaaattatctgcaaaaaacagcagagtgcaaagaagcagaaataaaacctcccataatcacaacagaaacatctactactgttcatgatttgttttattttcccccaaatatattactgtgcatttttctttataatgccgagatcctagaatatgtgcgatttagtgttctgcttttcttcttaacgttacgttatcagcatttccaagtgacactgggactctataaacatattttaaatgactatatcttatatggatgctcactccttttccttatatttgctctttactttttcctcttttttgctattataaatagcattgtactgaaatccttctgcagggttatgtacattacctcattggtttatttatttaacagactttgagtatctacaatgtgcaatacaatgtgcttttagttctgagaggaaaccatctgaaatagcaaaaagagacataaatgaaatacctcacatgtagagttttgtgatactcttttttatagtaagtatacctggcttggagtaacactgtgggccggttaattgttctgggcctgaatttctgcatctttagtcactagatggtttctaagctgcctcttgtctccagcactctgtggtcctgactgcaaatgtaagaatcaccgtagcattcatctatccttgtgactcactagggctgtttgtgtttggagcattcctggtgcacagatgatgtgttgatggacttggacacagtctgttctcttcccctctcagtcatgagcagagcgttcatctgctcagtgcttctttttaataagtagttcaggggttgactgcagctcagctctgttgggaattaacacagacataatagacttttataaaagtgtgagcagagcaactaagccagtacagactctttgccacatcctgacatgctaagagagaggtcccctttaaaacgcaagcagggtaaatattagaaaaatggtaagaattcatagagcataaagctcataataaactcagagaatgcattgtcctgagaagtggtaaaggaaggaagtggaatagacttcaacaaaatggcatagaattaacggcagagggtatcatgtacctgcagggtatttgaaccgggtgattttgtgtggcagtgcccgggatccacagaccctaatgacacccaaatttgtgaggcattcttctcagtttataaagaacatgactgagaccacctagcacatttaaccgggtctgaaggaccagctaatttcctaaaaatagcagtttcttgctgggcatatgtcttaggctttgctggctctaagaacttaatattaacaattcacacagaaggaatcgtgttcagggcattgaccaatactcagctcacctttgaatggccagaggacacagctctaaagaaaggtgtgcaacaaggagtgtggttgagtgggcatgttatcttcctaggtcacaagtaacaaagtgccactccccaactccatattcataacagacatccataatctatcaggatgttctttctagccaagccaagatgcaacttcaggatcttttttaacacagtgctccaggcagccactaccacacagatggggttcatttgctcctggaataaaaccttgtcatccctagacatagaggcagtctttcccctgtgagccacagcatatgagaaaatgtcaccatctagaaggttccttggtaagcacagacatatggtggcctgataaattgcctttctctacccttgggatctttgtccaaggaactaggtgccatcttgagtcagactggcaagtgtgggaaaatagaattcttattcctatcagccaacagaatcttcagtgtttcgtgttatgataaggagttacactgcagacatttctcagagggtctgttcctgtgttttatcatgttttccatggcaacccctgtgggatccacgaagttggtattatctccatggcacagatgatggaggcccaaggaagacaaatgaccggcaggaggcaagtcatgcagctaagagcttttcctggaatccaggtgtcctgccttcagatgccagttctcttgctggttttcgtttttgtttttctaaaaatgttttcacctgtcaagtatgtgctactatgaattctgggagggtagggtcgtgtcttatttatttctgtgtttttgactgcttttcctctccaatctcaagtgctgtgactaacacataggaagtactcaagaaaatatttatggcatataagtcagtagaaaatccattcattcattcattcatggaagaaacaaggaggtgccccgacctcttttgcatgctggcctttccaagtctgcactgggattgtgccctgagctttcatcataagagcagggttctggctgtgaggcttacctgggcacatgcacctgagcagcagacgatgacattatcagtccactggagacattttcttcctcataaaaaggctagtcattaaatccttatttgcagcctgtgacagcaggagccaaaagcctctgacccgctcaggacctggggttagagctgcatggaccctgaagagagggatccctgtgctaaggccttcggacagtggccctgaccgagcagcagagggaagagggcttagggagcgggaagcaccaatgctgggcttgcaaagggcagagcagcaggagagaggctggcataggagggaggagggctcacaggagtgggaggtggattggatttagggccatcaggaggggtgggaggccaaacagctcagctccccagtccctttctggggccatctttgttttctgatttataatgtgtcccctttgcggatggccttttgacatgtgctaattataaattgtcctttggtgcattccgagagttctaataattagaatttctaattccagtcctctgagctgctcccagcagcctcatcctgtgagaggagcttgactcatttgctctcctgctcaaagtcgctggaggaggccagcaccgtgcggcctggaggaagtatccaggtttgggggtacgggtggaacttctttctgcaacccaatacagataacccagaagacccttctctttgtggttgtggtttgtgttgaagaggaagattttgaagtcaaattgacagggcaggatggtctatgaaaaagaaccctggactctggttttagtccagccagagcctcactgtgagaccctgagcaaggagatctttagacctcagtttccttggcataaatccaaaggaatcagatctgtgattgccaagggcccttccagttctgagattatttgaatctgtgaaatgtgcatatggcgtgttctgggtggaagtcctcaggtcatgttttgaccctgcttgtactggctacaggactttgtttgcaggccatgtgataacaagatattaagtgactttgttaaaggtcaaagtaagaacccaagccttgtgcttttttttacactgccttattttcatcattaatctccccttgccttggtttcttcatctgtaaaatgggaataataatacctgggagattgtattggtgaaagctctatgtaaaatgcagaccactaagcgtgtgtaaggatcttaatttcacttctagcctttgggagatgcaagttacgatttctcccctgcctccttcagcacgaaaccacaatcctaaagcatctttaggactgtatagtaatgtggcacctaggtttgtggtggggagaagacaggcactccggccccaactctgaagacccaccttgccttgcccagggagttgccccttggggaatctgataaatgtagatgtcagtcttgagaagccactgggcacccacctgtccttgtcctctttcgtaatggtgagcatgcttggcatagtgtagactttcactggtacacaacacgtgcactcctattatctcatttacagatgcccgggagggggacaagttgaggcacttagcaaatagagcagctgggacaggaacgaaagctcctagctccaggaaagagtcaagcagcctcctgacatcacccacacctctgtgtgctccttctgcagttgtcccactctgtcctccagggcttctcccttctaggctcatgatctgaggctgccccttgctacccaggggcaaaattgttagtcctggaaggctctttaaaggtcattgtgggccaggtgtttcagttaactgatgataggatgggggccaacataattgaatagttcccaagactgagcagcttgctcaggtagcctggctaaacccaccagctctcccggccaggccaatgtcctttctctgacaccctattgcttttctttccttacattctctcagggagtcatatacaatgacagagaagtccagggctctgtgttgtttggctgtccagtctttgggagagagagaaaaaaaaaagaatgtggaacctccagacagggcacaccctaccgcgccccatgtgagtttcctgaggtgctgtaacaaaggaccatcgcctgggtggctcacacaaccgacagttaccttctcaccctgctagaggctgtaagtctgaggtcaaggtgccagcaggattggtttcctccgaggcctctctccttggctcttgtagatggccgccttgttttccctgtatcttcacatggtcttttttctgtccatgtcctaatctcctgttcttataaagacatcagtcctgttggatgaaggcccaccctaatgacctcatttaaccataatcacctgttcaaagaccctgtcaccaagtacagccacattctgaggtcctggggattaggatatgaacatgtggatttgcagggaaccaattcagtccgtaacactctctctcacatcatgccgtgtgtgatttacatgtctttgctgtgtgtctggctcttgtagactttgcgttttcacccctgtcttcctgttggaagtcttggtgaatgatcaagggagaatgtaggccccagaatggaaggagtgtctcagggacattagagagagggaagcagagagactgcccacccacccttcatcattgtgactgctctaaggaccggccctgggtgaggcggaggaggagcgcacctgttcagaacgcagcgaggctgagcggggagctagctggcagtccttctagggagtgtagctgattaaaataattatattaactggccctcaaagagacttatttatagccatggtgacacgttattaaggatctaatttggatcaggactctgggaatcttatttttaggcccagaagagagccctgcaggcaggtgaccaggaggtctcagatggctgtgtattcactctgtcgagtcagggattctcaaggtgggaggcaattggaaaggtcgcactggcccacccttcccccgatgtctgtccccctgctccagtgtcccactgagagaccatccacctcttcttaaatgcctcctgtgccagggagcctgtttccatccacggaggcccctcctatcttgtgaaagtcaggctctactgaaaagcaagagagagatttctctctaaatcttctgtctggtggttctggtctccccctggggatggacagaatacatctgaccactgggccactctcttcaggcccttgaagacagggctaaagctcttcttggcctccactgctccaggctggggcccccagttcatcagcccccctcaggagataattgcaagagccttcactgctccgtttctcagaggatgtgagtgttcagttctgcggtccagcaactcctccaatgcctgcctcctggggatagctgtaattctgggttgagatgaaagttggccagttgaagtcaactggcctttggttgagggcctatggtgaaaacagacttcatctaaaaagaactcagtcagcaggcacctgcactttggaatcagggaggagaaagatggagactaggaactgacagaagggttttcctcgtgtgaagggcagcaccaggccatgaggtgacccagggcaggccacagccgtggagggttagggtacagcaccctggtgggtggccccgctgggaagtgcacatttgggttttggtttgccaaactcaccctgcccaatcctagtacgagcccaccatgaatgtcagacagcatagagtaagtgcacctggagcccatcctgagcccttgagctaatgtcttcactcctctgatctctgggttccacctgcctcctttgttgtttgaagggtggaacggactgatgcctatgaataaacacaagctccagcgctctccacagatgtcacagatgaaagactaaaagctgcttctgcacgcacagatatttatattgtagtgccaaacaacaacagaataaaaagaaataatttttagatgtgggaaaatcagactctagaagatgttttataggagctatcatggtaggatggggctaattttccaaatgcctattttcctctgcttccttttaaagttctctctctttttatttttttattaaagcaaggaaataaacagtatgtgtgtgtggtgtgtgtatgtgtatgtgtgatgtgtgtttagtatgtatgctctctgtgtgtgtgtgatgtgtgtgtgacgtgcatagtgtgcctaggtgtgctatgtgtatgtgtctgtgtctgtgatgtttgtatagtgtgtgtgtagtatgtgtgtgtggtgtgtgtatgtgtatatgtgatgtgtgtttagtatgtacgctctctgtgtgtgtgtgatgtgtgtgtgacatgtgcatagtgtgcctaggtgtgctatgtgtatgtgtctgtgtctatgtgatgtatgtatagtgtgtgtgtagtgtgtgtgtgtgtggtgtatttgtgtggtgtgtatgtgggcagtgaatatataatatatgtgtgatatgtgtggtatgtagtgtgtgcagaatgcgtggtgtgtgggtatttatgtggtgtgtgtgtgtggtatgtgtatggtgcatgtgtgtatgtggtacatgtatgtgaatatgtgtcatgtgtatgtgtgtgtggtgtgtgtatgtggcattatgtgtgtgtgatgtgtagtgtgtggtgtatgtatggtgtatgtggtgtgtatatatatatggtgtgtgtatagtgtgtgtataccacttgtatgtttatgtgtgtgtatatatgtgtgatgtgtgtatagtgtgtacatgcgttgtgtataatgtgtgtatagtatgtgtgtgctgcgtgtatatttgttgggtgtgtgtatatgtgtggtatgtacgtggatggtgtgtggacaatgcgtgtatgtgtgttatgtgtgtatgtgtgatatgtgtatataatgtgtatgtgtgtatagtgtgtgtggtgtgtgtgtgtagtgtgtgatgtgtctatatgtgttgggtgtgtattatgtatgtatatgtatagtgtgtgtggtgtgtgtgtgtgacctgtggtatttggtatggagtgtgtacagtgtatggtgtgtgtgtagtgtgtgctgtgtgtatgtgtatggtgtgtggtgtatggtgtgaagtgtgtgtgtagcatgtattgtgttacgtgtgtggtgcatggtgtgtgtgtagtgtgagttgcattgtgtgtggtgcttggtgtgtgtatgtgtgatgtgtgttatgtggagtgtgaggaaagtactgggtgatgggtacatgtgaagtgttgggggtagagggtgagttttgtaagtgcgcactgagtaagggggggtggggtaaatggggggaggagaattgggggttggatgtgcgttgtgtgggtaagggaaagttgagtatgggggaaaagggggggagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtgttgtatatgtgttgtgtgtgtagtatgagttgtgttatgtatgtggtgtgcagtgtgtagtgtgtgttgtgttacatgtgtgttgtgtggtgtgtgtatggtgtgcgtctatccattggatgagccgggctgcctctctgagggcaggaggccctcttgcctgcttcattccccaccccggttttctcctcactgcctcagctggcatagttgtgcttgatttagctcaaggaacaaagtaagagaatccaagtttttggacaaaacaaatgcctagaaattgtgcttctaaagaagtagtttttgatggctcttgtagagaaaccctggttgcttgaaatgaggtgagagtttcccaagttagaccccagtaagatggcggagcctgcacacaggctttaaaaatgattaaattactcgttcagtatgatcaggattatggtcaagtgccttctttctgctcttctgtctgacttgcagctaaaaataaaagtcaggaattagattcttctttttcttctccactgaagagcaccctttgtggtcgctggcgctggttaggaggagatcccctgcccagagccctcatgtggggacaggatcttccggcagcactgggtgttcaaggtagggtgccgggcctttggtttacatttctggatgaagctcttctgctgccctaccctccctctgtctgaggccacccggagtcttccctttgcggcacacagtaagcagctttagtgacacgtttccgggcctcacctcctcagtttgctgagtctccattacatctgtggcaccgtttaagcagcccataatcatttgtggggtaaattaatacagtacatgtctcaggccctcccccaggattggcatagggaactgagaattccacctgtttccctttcctggatccttgcagttggtgaccagtggagaagatggccctggggtttcctcctcagccccaaattcctacatccctccaaaagaacctcagagagcaaaggcagccggacgcatccgaccctggcctccttctcaccactgctgacagaaggagcagaatcttggcagcattgttaggtcttcatctgctattagctgattaaaaagttaaaaaaaaaaatctgtatccctgggtagcccagcctgttccttgctgcagttgaagactgaccgaggagctatcagcggcttcccggccactgtggtgccatttttggcctcaaacccattgtgaattgctatcttttcccccagccatcagccggaagatccattaacaaattaaaattccctctagagtcagaatggctttggtttctgggttctaaatgaccttgattttaattaccatgccatacaggtttggaagaagacaccatcactgaatccctggctccttgctgaggcagcagagagctggggtattcagtttggccacacttctgggcttgtgggtgatacctctgaagtccttattggtttctaaaggtctttgtgccactcccagtttctcagtcagctgccagtgagttcacacacctctgagaactcttccaggacccccagtaagcttgctctaggccccaaggagtcccctctggcaaccgttatattcagggacccttctcaagacaaatttcttgaggagacacagttctggcgctgccctctaaacgctgtgttttccttaggtggccaggcaaactgtccagagtggtgtctgctcttcacctcatcttgaaggtggacgtcttgaccagaaatcctccttctccaataaactggaaggagaggcttctaatttctgtaatgtggggacttggatggcgtgtggatctctaactgcatcctaagttgtctaatattgataaaccaaggagtagcggggttcctattgtggcctttgaaggtattgggtggagagaacacaggatgggcaggcgggtcctacaacagtcagcaaagtacatggctagagcaaaagaaaccttatgcaagtgcagatttgggactcaaaccattcaaccttaaggtgcttggggcgaagtggtcggggagggtggtggggattgtgaagtgtgtgacttgtctgcagaatttactgttctctgctttcattataagcctcttttctcacacagaagagtaagatgaagcatgcagagaccaggttgggttaagactctgtactaatcacaagtagtgcaagaaacatttgctggacacctactgagtgctgggaactgggtactcaacacatctctgtgaggaagggactattatcatttctattttcttgatgaggaaagggaggcactgtattagtttgctaggcctgctgtgacaaagtactacaggccaggtggcttacacaacagaaattaattttcttacagttctagaggccagaagtctgagatcaaggtgttggcagggctggttccttctctgggttgtgaaggaaggatcggttccaggactctctcattgccttgtggaagactgccttcttctccctgtgtatgtatcatctccctcctgtatatgtctgtgtcctaatttcctcttcttctaaggacaccagtcatattgcattaggacccaccctaatgacctcattttaattttatcacatctttgaataccctgtctctgaatacatcccattctgaggtactgggcattaggacttcaatgtgaatttttggtggggaacataaatcagcccttaataggcacagaggggctaagtaacttgtgtgtagacacagagctataggagaagatggcaggcattctgactccagaatcccctggttctgacagaatcccctgacagttctgacagttcgagaccagcccggcccacatggtgaaaccctgtctctaccaaaaatacaaaaattagccaggcatggttgtgcacatctgtagtcccagctacttgggaggctgaggcacaagaatcactggaacccgggaggcggagtctgcaataagccaagatcgcaccactgcactccagcctgggcgacagagtgagactctgtgtcaaaaaatttaaaaataaataaaaataaaaataaaaacaaggaaacaatatgattgtactattcaaaggataatacttaatttgcaaacttcatattaattcctagtgtactaccagaatgagatctggtaacaggataaaagtttaaatcagatgatcaatgccatattttttccttccatgaatacatctccaggaatgtgtacataacctaatcaggaatagcttcaaggtcaaaattcgtggtccctgtgaatgtagaactcggcgagtggccaagtggccctgctgtgcctccctgcccttttggagcagcctttcagaaacttctggactctctgaccactgtcctctctcaagtctggaaacttgggaactaaccttgacctcgagttggctttccctaggggcaaatgcaggcgctggtggaaaaggctatggcctttatagtctctggcagctctgtgtgtccacacaactgtgatgctgtgacatagagttctgccactggattctatgactgaggatgaagtccaactaaattgccatgtctggaaccctgttggatcatcgcactggcaccctggagtcccttgggatcccctattcgctcagcattacatctgctgagcactgctcagtcaacattagtgaagacaactgcttcggagacggactttccatcatcaaaaaatgcaaccaacagagagcttgattaaagtgtagttatttggtgtgaaacatgtcctgccaacagtgtggcagtacagccatgaattaagatgaaaactgacacagtcactgagtctcagcctctgagaagcagctgcaatgtaagagtttttttaaaaaccggtgaatctataaggccaagagccaggagaggtgatggtgcacatcaaatggaggtggcaatggctttatgacatggtgcccttcacagtctggcctagaagtcaccttaagatcacaggctaggctctgcgttcctctagctggatttttcctagcacaggggtctggctttcttttttcttttctctactttttctttttttccttctcctcttccttttcctctcctcccctttcccccctccctcccttttttctttctttcaggtcctgtctatctgattgcaacttcactgcctctagggctttcaaatcaaaggtgataacctgcctccctcatggacatcagcatcccacgtgacagaacaggcaagccctcagttctgtgaagggtggtcacagcagacggaaatgtcctgcacaggaggcttgtttgctcatattctcccctccttacctttctggctccttactctctcactagagctacattcagcctgtctcttgcatcagtctttctgtgactattgaagccttcaatggttgattatataatgcagtgaactcatttcttgtagttgattacaatttaacatatatgtaatatgtagtatttgtttgtgtacttgattggcctttgtctctcactagagaataagctctttgaggacaggaatcctttctgcctatttcactattgcactccagagctcatgcagtaggttctcaatgcatgtttgttgaaagactgagtgagcatcgtttgggctctctaaccatcctctgagatacatgggtggctgtgtcaattgggctttggagatgaagaagcagctagccagcagatgatgcaggcctgggctttcttagcacagtgtgtttggctcaagaggaccacagtgatatcagttactcccctgcccacagggagcttgctctctagttagggagaccaggcgaagtgagggagagtgggtgtggagagtccatgctaggcactgaggatcgaggagtgagggcagccaggcttcagaggggcagagaggtctgggccaggaagaggtggatgcagccctgggcctcatggtctatttttgccttagttcctgatgctcccgccaagggtatgcccttgctgggcatcctacttcctgcccactgagctcctgccaggaacactttcttgggatggtcccattttctgccaagggtggatttggatctcttctttccctcttagcatcccatgggtgtctccataggctgaggcaggttgtggactgcccagccccgggaagcgtcacacatctagaccaccatatgggcagtgcctcctgaagctgtgcaatggagcagccttgggctgaaggatggaattgggaatctggcttggactggttcaccctcttaatgtaatgtataaaggaagagaatattcctagggagaggctacccctcgaccagtttttctagtctatgttggagggagcccacactcattaaatgcctgctgtttgccaggtgccgatagggtgctttgtatatgttaaccttattcaatcctcttgatagccctctgacactggcattgttattatccccattttgcagatgagaaagctgtggttcagtatgtttaaatggctcacccaaggcagacacagctagtgagtggcagcatccagaatcaaactcaggctgttctaactccaaaactctgagtatttctgtaataccagaattccttttaagacctgggaaaagcccagcagccccaggaggtgccatcctggagccagaaggagggaccagcaaagttgccttaccatttgcattaaaacaccctccatagctgtagactgactggtgcccctgggtctgcaggtaccagctttgcacttagttgaatctccagccttaagtgtccttcccaaagcccagggaaggcaacgcagtttgctgcagggatcgtggcctatgcaaaggcctcattgccacgctcagcatcatcagagactgtatgtttggtctctggatggaggccgagagggactcaggcctggccgtctcagaacttaatacttgagttaccgagtgtgtgtgtgttttattttggggtgtgcttaagtctctcatctatttttgttttagaattttggctattcctttgttacctacccaagttgatttatacacggccgtcgtcctgtgcagaaggcaggtaattggccacttcagccctgggctaatggagggaagcaattcatttgatgaaacaagttaagcaataatttagaaactttctatctgaacccttgtgatatcatatcctcccagatttatcctcttaactctgtccaactcaggcaatagtcagaatgtcttttcccttcctgtcctcacaccagtctgggtcagctgtcaaggacgtgggcaccttgaggtacttaaaagagtttctcttagagggccgggagcctggcttcccgtcctggccctgtttctcactggctgtgtgactctgacccactcacttaacctctctgagccccagaagccacatttctcaagtgcagtagtgatattgaatgtcccaaaggcaatgggtaacaccagaccagggatttccagatgaaatgctctggcttacttagcatgactcagacccgctgcttccccattagcaagaggctgctttataattttttttttttaatggagagatatcaaggcttaaaatgacattaagaagtcttcttcctgactgcagtgtgtccttcaaggatcatctccccatctacctctctgtgtactaatgactccaagaaagcggaagggggcagcctggtagaaaatggaaacgtttttctgtaaaggccctcccatgcttccgaggcctgcagatgaagggtctgacttgagcctctcagaacccaggagaaagaaacaagcctcactcatcctgtagcccagaggaagaaattctagcacccagagaggtcaagcaagtcctgcaaaaccacacagcaatttgatagcaatagctggaccaggaactcagggattttgactcctaatcttgtgcttctcaaactttagtgtgcacaggaaatctgaggatcttgtggcaatgtatattcgggaggtctagggtggggtctgagattctgtttttctgatgagagccctggtgatgcagatgccgctggtctctggagcttacttggaatagcaaggggctccagaaagctgggaggctggggtctttgcagcccaatctaggagggagtagcccttccagctcctgtcgcctgtcccacttcctgttactaatttgcatgttgcctcctttctttccctcatgctcctaaggcctgggcactcccttctctgccaccccctatgcttccccagcccattttctctggttccgtcttgctcagcctttaagtaaacagcacttctcagctgggttgcatgaggcctcctggctcaggagtctgctgctctgggctcacagtccctgttccatggagatttgagtgcctgaattaactccctcttggagcaataaaccaccctgagtgctaacctagtttgtatttttagcgtgtgctccatcaattacttaacttgcagagcggctcctctctgctcatcagggaggtgccaccaaagaatgttcttcctcaggcttattgagttgcccctctccttggtcccacctcctgtgaggtcagagtcctttctccttgatgctgtatccttggtatttaggaggcaaaggttattcaccccgttttatagaagcagaggaaacactgaggtccagatagggtgacaacacagtacagtgtgatggtgccaagaagcaggtctcctaagcccttcaccttcccactgtggggaggtaacaaatgatggtgggtggtatcttcccaggctacgcagggccaggaggctctctctgagccagttttgcaagatagtgatatgaagggaagcaggtgggggccatgcactgtgttacctcaggtagaagtgagctcctcactgtggtttttacttgtaaagtccagccagaaaacctacatgctgggagaatggggccaggaccactttagtcagtggtttcttccaccttctccccaccccaggaggaccttcagccatccctagataagtcaagacttggtttgagtttcatcgaggtttctcccacctctggcagaggcatggatcagcaacactccaccaagaggccagcaagatgctggctgtttcccaagctgggatggggtgagagagtatggcttggaaactcagaggtgatagaggcagcaccggcttcctgagccaagctctccccatggacccaaggcccaggcatgagacgacttcattcatccgtccattgaggaaacgtgagcactagttgtgttcaagacaccaggcagatgctgtgggtgggcgggactctctcccgggggagagcccagggcacagtccctttcccagggaccttacatcttccagggaaagctcccatgtctgtctgtaaaggtaaaagctaaaaacatcacacagtgtgtaagtgcatgtgtgagggtgtgtgtgtttatccgtgtgtgcataggtatataagggtctctgtgagcacatgagcatctatagatgtgtgtatgtttacgtgtatgtatgtttacatgtctgtgtgtatgcatgtgtatttatatgtctatttgagtgcatacatttgtgtttgtttgtaaatatatgtgtttttacgtctaagtgtgtgtgtgcacatgtatgcatttgtttctccatgcatatatgtatttaagtgtatatatgtttctgtgtatgtgtgtgtgtgctcatgtgtgtatgtgttagcatcagtgtgggtatacatgtgtatatttgtgtttaggtgtgtgcatctatctgagtatatgtgctgtgtgtatttatgttagtgtgcatgtgtctgtgtgcctgtttcattgtgtgcatgcgtgtatgtgtgtgcatgtatgtgtttatgttagtgtgtgcatgtttctgtgtgtgtccgtgtccgtgtgtatgtgtatgtgtgtctgtgttgtttatattagtgtgtgcatgtgtctgcttgtgtgtgtgtgtgcatgtgtgtgtctgaatttgtgtgtctgtgagcatggtactttgggctgtgcctctgtgaagccccatagtcagtggggagtccccacacagccctggctataggctgctctggaatttgcctttgatgacttagataggcatgaacaggacatgtcccctggggaagatctgtgagtctgtcctgggtgtccccggggcaatgggcagactcacggggaaggaagaggaagacaaagcacacagggtcaacactattgcatctggagcgtgcctgggcccatgctggatatgtgacagactcagaagtgagccagacctgtctagttggggcaacaagccccgtaagtgttctgcctggaggggtgctgaggcaggaagtaaggaacctctgtggaggggtgacctagtccagccctaaatcaagggtagaaggctgggtgatctgtgtccccactctcctcagtattgaaatctccttaagcccaagactgtactgaatcatgaatcaagacacatccatgtctggtcctgactctgccgtcactgtgtgaccttgaataagtcgcttggcttctctgggccttgcttccctccctgtaaaatgaagacattggatcatctcatcatttaacaggaacaatgaaattctacagcgaaacaagttgccccacaaatagcagggtggggcaagggtcaccacagaagagcaacttggaagtggtctaaggatgtggctaagaaaagagggagggtccagggaggcctcttttttgaaaaaaaaaaaaagagggagtacaagtgcggttttgttacatggatatattgtgtagtggtaaagtctgggcttttagtgcacccatcacccaaatagtgtacattgtatccaataggtaatttttttttttcttgagacagagtttcactcttgttacccaggctggagtgcaatggtgtgatcttggcttactgcaacctctgcctcccgtgttcaagtaattctcctgcctcagcctcccaaggagctgggattacagtggcatgccaccacgcccagctaatttttgtatttttagtagagatggggtttcaccgtgttggcaaggctggtcttgaactcttgacctcaggtgatccgcccacctcggcctcccagagtgctgggattacaggcttgaaccaccatgcccagcccaataggtaattttttatcccacaccccctcaccgtcccactttttggagtctccagtattattattccattctgtatgtccatgtgtactcagtttagctcccacttataagtgacaacatgggcttttagtgtacccatcactttctgtctgactttgtttctgagttagttcacttaggataacggcctccagttccctctgtgttgctgcaaaagacatgatttcattttttttctaaggctgagtaatattccatggtgtgcgtgtgtgtgtgtgtgtgtgtgtgtgcacgtgtgtaccacattttctttatccagccatccattgatggacacttaggttgattccacgactttgctaatgtgagtagtgctgcaataaacatgagtgcaggtgtttttttggtctaatgatttcctttcggtagatactcattagtggggttgctagattgaatagtagttctattttgagctctttgagaaatctccacactgtttcaggaaggctacttgagcttggtcttaaaggatgggtggagagggaggcagagagaataataatacaggaagaatctgagaggtgggagagcgcagcagactttatcaacgaacattcatatagcactcactgtagagcaggaatcattctaagataggggttagtaaactatggcctgcagggcaaatctggctcactacctgattttataaataaagttttattggaacatccatttgtttacatattgcctatggctggtttggagctacaaggaccgaagtgagaggttgtgagagtctgtgtgacctgcaatgccatagaatatttgctatctggctctttatggaaaaagtttgccatccttcttataagatctttaaaagcatgggctcatttaattttcttgacaaccatattggaaagttattgttattgtgtccactttatagatgaggaaatgcaggctcagagagatcaaatagtgcgcctaaggccacgcagtgaggaaggaggagatgagacatgacctcaggcagtgggctccagagagtctgtgttctggccactgtgctatgccaagagcgggcccctgggaggaaggctaagctgtgaagattttgggtgctggtcttcagagcactttcttgaccttgccaggtttgtgaccagcacagtgatgtctcaaagctgtgttttgattaccacaataatgtgggtattcggggaccagcctgcctaatggggacgctcagtctccaactgtgtctctcaaatgctagacagttcttggaggcaacacctacatgctgttagccaggcactgctcacaagggtttctccataaagatttccgattttagcttattagtcagtgtttgtatagttgctgcatgctgtggtctgtgtcccagctgcctgctgtagatcacaaatgcttggaaggcctggattgtgtctctctctgtgtgttgtctccagggagaatggcttgtcatcaggtcagaggattctggggccacattcccattgcgaagaagctgtcaaaatgcctgcatccagaggtgcttcaacaagagcagaggtgatgtgcaggaagggctggtgattgtggcagaggctgtgaatgccctgcccatgcccccaggccactctattcctatcccactcaaatgcccctactgtcagtgccttccctccccctaccagtgtgagccaagacatctggaagtgcctgcagcaaatacccccaggtgcagcccttgccaatgatagaccctaatgggagtataaataccccagattctacccctcagatgacacagctctgaggcatggtctatgccagtgctacccctatgattttctgtaatgatggaaatgttctgtatgtgtgctgtccaatatgatagccaccagccatctgtggttattgagcttttggaatttggctagtggactgaggaactaagtttttcaattcaagtaatttaaatgtagatagctcaatgtggctggtgccttccatgttggacagggtggttctgccccatctcccagaggtctccagtggcattgagccttggttgtctgcagcagtgtcctgaccattaacaaaccctgccctctcactttcccattttatttccccactccccagctggttctcccctgggatcactacccaaataaactattcatgtaagccacatgaaattgccatttttgaggttaaaaaatggttgaatgtcagtattttcaaatgattaaatttgcactgaaatctctaccatgcatgtgtgtctggggaaccccaccataacagggagttgagattcgtgtttgttcatgtgtgtaagttgaagtcattccctgtccaggcagggttctaatcccagctctgcttccaagtggctgtgtggccttggaaactctctgtgccttggtcctcagggaggaggacctgcccatacccctggccttggtgcctgccctatctttagaatggttggaaggaacaagggagctcatagatagggctatttgttaaaagaagccagcacagtgaggagggaaggtgccctcctgcatgggtggggccattctggggcacagtgccctggctgcattatccctgggtggaggatgcctgcttgtggctgatggaattcagacagtgtgtttctttgatgctacaagactggctttcctgctgccccactttgtataatcgggtctttttggcagggaggacttagtagctagcgtgagctcccaagtaggaactctaggaatattcactcgggctgccgtttgatctgagcaagagcatgatttgatgggaggctgctctgggccttacatttgtttccctcatttagaaaaaggcagtaaacagtttttaactacattgcgattgtgaggcttttcctatataactttttttcctggaatggaaccagacaggatggaggcactgcactcgcaggcaacatgggttttcccagcccctccatcttcttgaccttcctagggatttgttaattcagctcagattggcctttccaggaagctaccaggctctcagaatgcccgtgctggagggaggctgatcccaccagggaccccagaggaaacccagagttcatgccaaaatatctagtagaaggagtttatatggggaactagttataaaggtgtccaaggagataaaaagccaagcaaaaaatggagaggcagcccagagaatagcaatggcaggaagctgctagcatcctagggctagagggggaagggaggagctggttttctagaactcaggatccagcagcacctggcggatgctggaactacagaaggcctgctgggctgggcaggatcacagaggaaaggactctggggagggcaggatacccagaggtgatagatataatgatggacatgttctctatctggagatgccaccaaatgcagaaggagggagaaatgtcctggtttctgcctgcccccaccctgcagacttctgcctgcattcctgctgaatagaacaaacttccctagaagaaagagcgagggagcctggggagtgtagtccacagtctacagacgaggggtaaagactgggtctcagagcaagcaggccaatgactagcagggcggcccaagagcctttaagtgagaggctgtcatcctggggctgtgaatgaacttcggaggggtccttgcccttctaggaagtgcaggcatattttgtctctatgtaagcacatgcatttctccagaaagaaagttgatatcttcagattctcaagttggtctgtgccaccaaaagattcaacataatcaataaccagtaatccaaccagcttatcttaaacatgggaagtctcagggctcagagaaacacccatagcgacagtgtctatactcttggtctagggtcctactggatgttgtccttcaactgtcctggaagatccagcctgttaggagagtcccctgtctgttccctgcctctccagaatcaactgtgtcccatcttcttggtcagctttccctgatctcaagcacacagacctgcttccacagtgcacttctgcagcctggggaaaccacaccatggatgtggatcctggtctagatgcgccacatagtgctcgatgcaggcagagctggcactggaaagagggcccagtctcctccatgcagcctccctccttcagcaaacatttgccttgcacctgccatatgccagacgttttgctaactgccggggatatggcactgatcaagatagatgatgtccctgctgtcacggaggtagaagtggaaacagaaaacaaacaagagaacaaatgcagcaacaaggtcatttctgattatgataagtgtggagataatagagtagggggctggcagacagtgatgcgggtagagtctgggggctacttttgatgggaaaggtttctctccggaggtcctgtgcaagctgacatgagaaggatgagaaggagccagctttccaaggtctccagagaaagtatgccacatggggacaaaagccagtgcaaagtccctggggtgggaatgagcagaggaagaagaatccatgcctatgtggccaaagacgaatcctgcctcacagtctttgactcttttgacttcccctgtcgtgcctcctgcagactcttcttgcttccctgggagaatgggtggcaaagagtgccttccttagccatgcttccttgtcagcacagtgcctggcaggtggctggaagctacagctgaatttttgcagtgtctttgagatgccaggaggatggcagatcatttctgttcaattcatcagccacacaaaagccctgagatcaaagagcatgggcttaatttattttgtttattttgcagaggaaatagtgcttccttggactgaaagctctgaggactaagagctgaatggaaagggggcgtttggattaaatgaatgggctggccagctctgacccaatttccacccagtgcagcagtgatgggggagggaattgccttctggctctctgctctggcccaggggctggtcatttctcaggtctgggccttctgtgtgagtcaggtttgatggaagtgtccttgaaggtgattcatggggaagagaggaggggaaccgggagtagtggcctcaagccctgcctgagttcatccttggatccctcagcctttcttgacactagctcatcaccttagcaatgaggacaggtgcagattcaggtgaagctcacctacatttcataggagcctatcaaatgtgagtggactcggagaaggaaatcactgagcctcacatggcaaaggagcactcaaagtagggaattctgaggaagcctagaatgggctgggcagggagggcagggtacagtcccactcatcatcgtgaccaggctggacctgtgattgcagtgaatgagacttggccaggagaggcttgggtctaggagtcctgggttcgagttccattaattatttgaccctgagctggtgactttttctattttagaagcctcagcctcttcacatttttgagtaggagtaagggtagctgcctgtgcttgggcttggtgtgagagcccggttctgaagattggaaagtattgccaagcacatggtaggtactcagtaaatatctgtttacttaaatgaaagaatgcatgaataactgaaagagatcaaagctgatatattcttctagaactttatgactacagggaatgaagattaatatggcaaggatagggaggaagttaaagccaactgccacaaggtacctgtggtggagggtccagggttctagtggcttggcccactctttcaggtgccctcatctcagaaagatcaatggtgcagacagactgcagtttatctagttcacattggatggatgccttggatccacagccctaggatacttgggcccatttttggatttcttgctcttctagattgttttagacagcagtccatatgaagaccttaagagagaatatagcccaagagtgatggaaggctgcaaccatgacattttgagtatgctccactaattaaaaattaaattgttaatccccaagtaaagaaggaaaatgtgagggcatctgaagaagagagcatgttcgtgtatcgtgatcgctgatcaactctaggtttaacagacagaactttatgaatgaggaatgaggagtcatctaacttagggtagagtgaaagggggtcaggtggctaaaacacaaaactggtgaaaactgctaaagatagccacagacatttgtaaaattataggcagagaattagaagatgaacgagatgggagagtatcactgcttgggaaatgtgacactgttagcaaacagagaaacaaactagaaagtgagcatttctgttttttttctctctcttgtttctacctaggattactgtctttagaatgaaaaagagaaaatctcttgcacagagctagagaggcactttgaaatgcatttctaggaccagaggggctctatggctgggtcctgaaatacactgtagatgtggttgcagaagtggggagtcttttgatggactattttttcattatgggttcaatttttttgcctttttgaatgcctggtagtttttgattggataccagacattgtgaattttaccttgttggttgctggatatcttagtactcctataaaacattcttgagcttattttctgggacatgatcaagttgtatggaaacagtttgatcttttttgggtcttgcctttgagctttattaggtggaaccagagctctcttaatctagggctaattttttcccactacagagacgctgctattctcagtactctaccaggtgctctgtgagcttgaggtttccactctggctggtgggaaggtgaaccgttcccagccctgtataaactctgggaaatgttctgtctgctcctttagggtgtttctctcccccaccttggatagctttcacacatgcctgtgtccaccaatacttagctaaagactcaagggggtccctctgctgacctcaagtattcactgggcagttctttttgctgccctggcctgtgaattccagcctccttggccttgctggaatccagccttcatctcctcaactcagggagacatctgggccctgctggggtcctccttctttctgctgtgacttggacgctctctccagacaggaagttgaggcaactgtagggctcacttcgtttctcctctctcagggattgctgtcttcccctgactgagctccagtgtctgaaaatcattgtcttgtctgaatttttagttgtttcaggtgggaggagagatctagtccatgctacttctttggagaatctttgaatggtgagataagattatttatttatttatttatttatttatatttatttattttttacctctagcattctggaacttcttgtgcttgttagaatttctcagtgggtgtcagaagatggatgctgtaatctgtattctaatgatgtcgtggcttatctctggaaatactcttgattggattttaaaactgagtgcttaggagcccttagagaggcaaatgctggtcacaggggccaagctagactctatgcaaacaggtcaggctggaatccccagttatcaagggactgaagttaacctgaaacgtttcctttaccatgacttaacctaaggtgcatgataatgagtgttaactgggtaccaggcttgcctttacaccaggttctgtccttatagcaaccccgtcagctaggtacccccatccctgttttccagatgagattaaggaactttcccaaatttagggtctgaattcacatctgctcacccttaaatgagatgccgcattgggcagcatctttcttatcatcttgattagggaggatccaagagctggaacttgaatatgaatcagtaaaacaaaaacaaagaatcagacacaagataaaggatccctctttgtccctgaattgagataagaaaacatcatcagaagcagatggaggctaagtactgattcccagaaaaggcctcatttttagaagggtatttagagattattcagtccccaacttacagctgtggttggcagaagccaagtggccaacagctcttgaggtggtgtcatactcatgggcagacagaaacttccctgacaggattttcccttaaacctccatcgcatgaaaggactttttttgcgcatttataaagtgtataattactatcccagtagctagatgcaaccttgtcaattataaataaatcatcacctcgcctcctcatcaccacccaaatgtctttcacactccaatttaattaactcacttactttattctctaataaactttcacaaaagttaaccccccattcccagctccatctagcaaagaatgctggctggatgtcagccatgttttgggcccccacctgaatctccgcctcaaatgtaactcaaatgtgatcatctcccccatctggggtctcacatgaggacatgaggtatgggacatgaccaggaggcatggccagtcttactgtctggattgccctgggggtcatggcaggcgaaaagatcagagaatgagaaattccttcctccttccagaggccaggtgggagggcgggggaaagggcagggtcttgttgaattttgttaaaaagcactttgctctcttggaatgctatctcatgtctaaagcagccaagatcattaagtaaatataggatctgtgcttttattttcactgctattagcaaagtttgcaggaggaaagagacattgaatggggagtttcatcaaagccaggggtgttccacaggaaaatacttgttaggcctagtttcctgtggtgaaagtcttatacatttcaaatatgttttgtgactctccacaaactttttgtttcctgcaggtttgtaattgagatatatgccctggggagaaaaaacatccaggcatccaggtccttagaaatataggtgccctgataggactgtagctggcagacttgcccataaaacaggtgaggcaggtgcttgaacatgtgattcacatgttgcatagactgcctactcctgggcaggggcacacttggcctgtatttgaatacacctagacttcaaactcagtttgtgaatcacctcctttggaagctgtccttgcaccctaggctggaagcgagctttcgtcctctgaacttcaattgccctgtattcatacctctgtagttcgggctctggtcactttctacctgggatttgagttggtacatgccttctcacctactcgcctggactggactctcctttgaagacagggtcgaggttgaagtcatctttgtgacccctgcagggcattgcacatagcagatgtgacctctcgctggtggtcagatcaacttcaggggcacagggttcctctttttatctgcccgatggcctttgtctagtgtattgctcaggatgacaataagaggaagattctccccctgtttaattccgggatgtcactggtcaggctcctcttgtatctcaggggtccagggctgagggctgtggcttcagctgaggctctaggctaagccagtagggcttgtgtcttgtattattctgttctcatgctgctagtaaagacatacctgagactgggtagtttccaaaggaaagaggtttaatggactcacagttccacatggctggggaagcctcacaatcatggcagaaggtaaatgaggagcaaagtcacatcttacatggcagcaggtaagaaggcatgtgcaggggaactccccttaataaaaccatcagatctcatgagacctattcactataatgagaacagtatgggaaaaacatgcccccatcattctgttacccctgactgggtccctcctacaacacatgggaattattacaattcaagaggagatttgagtggggacacagagccaaaccatttcaggtctactactttggtaacctcctggaatgagtctcatggggcccttctatcccctgtactcatgatagtatgactctttgggtgggtctgaggctggacatgactggtggtgaaacccaaactcttattagagaaagtatatcctcttactagtgagataccttaaagttttgaaaaggaggctttttatgataataaaattatgcttttatgggagaaaacttggcaaatacagaaaaattataaagagaaagcaatgtctgtaattctgcaatgcagaaatcacatttgggtgtattttattattatataatgaaatgttattctgaaaacttagattggttaatatatataaatgttaatatgtatattggttaatatacataatatatgtaaagctttaaaatatacttagtttaaaaaataaatctgggtacagcggctcacgcctgtactcccagcactttgggaggccgaggcaggtggatcacctcagggcaggagttcgagaccaacctggccaacatggcaaaaccccatctctactaaaaatgcaaaagttagccaggcatggtagcgggcacctgtaatcccagctactcgggagactgaattaggagaatcacttgaacctgggagacaaaggttgaagtgagccaagatcgtgccactgcactgtgtctcaaataaataaataaatgaataataaagccaggcatggtggaggaccacttgagcccaggagttggaggctgcagtgggctgtgattgcaccactgcactctagcctgggtgacagagtgagacacattctctattttaaattaaaaataaataaataggccaggcatggtggctcacacctgtaatcccagcactttgggaggccgaggcaggtggatcatgaggtcaggagatcaagaccatcctggctaacacagtgaaaccccgtctctactaaaaatacaaaaaattagctgggcatggtggtgggtgcctgtagtcccagctactcgggaggctgaggcaggagaatggtgtgaacccgggaggtggagcttgcagtgggctgacatcccgccactgcactccagcctgggcgacaaagtgagactccgtctcaaaaaaaaaaaaaaaattaaaaattaaaaaaaaaattgaaaaagtgaaatgaaataaaagtaacacatatggtaaacattgaaataacttataaaaatataaaatgaaaagtaaaagttttctgcccaccctaccccacccaccctaatcctggaaacctctctccaaagatgtctactctttctaaattcctttgtatgcctgtgggtcctgggagggatgcatataccagcatttacatgtgtgaatacttagtttatttattgattcttaaacctagaaacatgtaatgagcatttccccttgtggttgctgacatttcaaaactatttttaatagcatcaccctagtttatcatgaggatatccagtctttattttctgttgttgggtgtcgagtttcttgccagtttatttcttattaaaggtaacacttcaaaataaaggcagcttttttatttaatataatttggtgtctctgcttatttttttcaggataggtttccagaaatgaaattattgtagcaaagaacagatttttttttatttcaatggctgtttgtaattttttttttttttcggagtcttgctctgttgcccaggctggagtgcagtgatgcgatctcggctcactgcaacctccacctcctggattcaagcgattctcctgcatcagcctcatgagtagctgggattacaggcatgcaccactacgcctggctaatttttgtatttttagtagagacggggtttcaccatgttagtctggctggtctcgatctcctgacctcgtaatctgcccgccttggcctcccaaagtgctgggattacaggcatgagcactgcacccggcctgttagtagtattttgttacatcaaattaagatacattttcaacagaaataggaccatttctcttgcccataaattctttttgatgatttgaagatttaaaaagtaatacaagaaaatatactattgataaaaatttcaaataatacagaagtacacggagggagaagaaaaaggggccctttctgaacctcccttctcacatctgaaagaaccctggaattggacagacctgaattcaaatttagatgtcgctgctgatcagttttatgatgttgcgagtcttgattgtctcatatgtaaagtgactatgtcaacaatagccttgtaagattgtggtgaggaaaaagtgaatgtgtgcagaggcctggccggtggcaggcactgtgacaattatcgtctttgttggtaggttgattgcctgttctctgtgtcatgtgtacccagcagactccagttgatatcaccctagaaaacaatttcctcattctgataaatgttggcccttttctgcaagattgctttaaatttggagccgatggaatcacaaggctgtgacctctccatgcaggagacagtgtttctagcagcttgaggggctgcagctgccccaccgagcttcaacgggtgtcctggtgcaaggttgtcctactttttgagtagcaaggtcttttcacccctttatgagaatgggcacactctggatatctatttctgagaactctgacactggagagaaaacaatcagttgagagaaatcccagcttggatgggcattcactgaacatccccttggaacatcagcctgctcaaaattttaggcatgacaccgtaaaccctgctatttatattgcaccagattctgcaaatatctttagtaacactaagccctcggttgttttaactgcgtctctaattataacctttttaatatttacagtggtgtcatgccatcctgattaaagtgccgtggtgagagatgctgttggcacctagtagcagcattgctgatgagaaggtgtcactaaagctgaccttccatcacttcttaagtgagccatcatttaggatggacacagaggtaccaatgagcccctgttcttgatcccaggatccaaaacctctcaggtgaggcatctccttgtgtgttcttcaggagccagcatgctgtgtgattcctagggagccagaggaagccatgctcttgtgatggcatatttatttcattggcctcatgtcatttggtctacctgatcagcagctgctgtgagtgtgcctgaaagagtggcaggctctgcaagagctccgtcagcaagtagaaatgctaaattatctcatgtgtttatcaaaggtttattgagcaccttttgtggcagaaacatgggctataataataatgaccattgattgaatttctggtgggagatgggtactggtggagaccagtttgagctcatgatgtttattaggaatccacctctgagaagggagaggcagaggccagagtgacaagagggacaagtcgagagctgatgcagcttccacaaaacctcggccaacccagcagacaactctggagtggatttatccaacagagatgatccctttgggcccaaattgctgtgcttctgtaccccacctcactctgtcaccagatgcaggctgtcccaggaagggtgaccttggctgaagctgtagctgaggctgagcctgaaggaaccgacagctgggggctgtttgcaaagccgtctccctgaagctgggcctcaagtccttcttcgaggtgaggttgggggcagcacatctccatggcatgcagagcttgatgaggagcttgagtttgacctgaccctgaagggcaagtggggctttggtaggcagagaggagcaggaagaacttgccagctaagcaaaacagtgtgaacaaaggtatggaggtagaaagagaggactttgtaaggaagtgccaatatggaaaacattgcagtgtggacgcctgggcagagaggctgtcaccttgagaaatggccaggggccacctctagggtgaccttctctggtgttactttctagctatcttctgaagcctgtctttcctgcccactctaaggaagtcaggtcaacttagggatgtgtcttcccaagtgacccccattggcctttgttggttgtcctccaagttattgccttgggcaactgggcagattatctgcatcttcttgcacagagtatggattttcaaggctcagctcatccttgactaagattgaggtgacttctagggcggctgaccggggccttgagaatctccctgggccctttcattcatttctcttcatgggctcttttggggtgggtgccaaggatctgggtacagcttccctaactcccaagcttggagaggccactctagctcttggactggcatctgggccagaagctaccagctaggcaacccatatttgctgggcatctaatagcccctcagatggtgaaaggctggtctttggcctggatggcttatctgtttcctcagacagctccagactgaagggacttcataggcagtgactctgtttagtttcactggtggtccaagggcctccttagctaggccctgggggaatcaggggctgtaagagtgggacaccgaacagaagtttcatctcatggaggcaggatttagaaagtgtagatctctttgaagagaggtttcagggagagaggtttcagggattagggtccagccagctccctcccgatgccagccttacctgctaagtgccttctaagctttcccactcaccctgtctgtgtttccagcctcttgtgtttatctctctctccagcccacactgccttttggccgaaaagggccataccttgagtccctgttgcatgaagttggatttcctttcatgtgtcctcagaggccctggcttgggtgttgtcatggcattttgtgatttgatggaggaggagagatagagcggccccatcgcctgtttgcgctagcctctctcagcttgaccgatgactgtgatgacatctgtggacagtaagcaggtccctggtgggattgagtttcctgagctattccatatcagcattcgagaagccagtacactggctgctaattgtgctagcttgtacctggggctgggtttgggtttcaggtccctcccttcctccctttctcccaatgcttggtcttattaggaaacattgcatcgctaaaataacaattactctacagatagagtaatagaagtgttcaaaggtagggttaattagaaactttcattaaaggaccttggaccttgttgcaattggtcattcattgatatttttctgatcaacaaatcaaccatagtttcttttgaataattgcaagattttttttatttttcatatgtgtgtgtgtgtgtgtgtgtgtgtgtgtgtctgtgtatgtgcgtgtgagagagagagagagagaatatggacgatgcagaggtggatggaggattattttctgttaaaatccccagcgtggctcagctcacctgtggggcctgcctcagctctgcatgccagctttgggctgccagatagtcttggagcttgccttatagaaagtggggatcctagccccatttttttcctgtggcttccctgggtttttctgaacatgaacaaaccttgctttccatctctaaacgctgctgggtggtccttgccgttgggattctggaattctggccctgtctggggtgagccttgggcatctatctcataggcactcatgcaacctcagttgggttgctatagaaaccaaatctcatggcctgctgggggcctgtttagttctttatgtcctgcctctgtctggggagataatgtggatggtgacactgttgttcactgctcaagtggagaattccctctatcacccaacaaggcttttcaaggacccaaccacagaagggactcggtaactcttgggtgtgtttttcctcttgctcggtgggggaatccaccttcaaagaggctgcccagctgctccctgggactcagcaggttcactggggctggtggtcctcaagtctttttgaatgccggggaagttcccaggacaatctccagagtggttaggaggcctggaattgataaccaccctgaggacagcccccgtctcaacatgggagacaagagaggcatatggcatggcattatagcattttacagctcatggaccagctgataggatagtgaatataattgccatgtgacaaactaaagtggctacaagtgagctaacaggtgtcgtttcattattaatttcaatcaaagtcattagttgctatttagggatctggctgcttggccacctacaccgtacttcatctggctgctacagcttttgaagaagacagagaaaagttctctttctctcctcctcctttcttcatccttggagaatttactatggcaaaacattgggtaagtctctggactaagtcttttcccagtgcaggagtctgaacaagtcactgcagtaattttgtatgctggcaagccccagccctattaagtaaggtcctgcaatgtgcttgtcacctttctaaattagagcctcatagtctcaaaacggtcctttgcagaaggatttctttttttaatgacttagcatacaggtcagtatcccatgtgtacttagaaaggatttgtaatctctatttcatatgcaggaagtctctctcccttttataattttaattttatttttactgataaataataaatgtacatatgtacatgtgatatttaatatagtcatataatttgtaaaggtcaaatcagggttattgggatatctatcatattaaatatttgtctttatgctagaaacctttgaattattctcttctagctactttgaaatatataatattttctaaactatagtcaccctactgatctatcaaactctaggtcttatttctgcagaagatatttttattttcattttagcattcagtatttctttatcacaaatctatccaaagattgtctcctttggttccatttgaaaagcaacctagaaagcactttagaggtggagctcagatgttgccatttctgaattagaaataatttggctcagaaaggttaaaggaaacagcacagttgacctagctaggaagtggcacagctaggaattgatccctggcctctgattccaaagcccactccctccatgttccacgagagccaatgcagtgccaggcagggtagattcctcgtgtgctggggtctctgaacttcatgaggggctgccattctctccaactggcagcgtctcaccctgccctccgtgttctctgtgaagcctagtccagccatactcccagcctaagaataattttccaagtcatgaccacaacccatgaatgctctgcagatgcccatgatggggggatagtgatggatctcaaggaggttggtggctatgctagaccatgaatgcagggcttctagacaaacagaaaccagtccctggcctgcaggagtgtcctggaagcctgccgggaccactgagaaaagctttccattgggaaaacatatgtaggcccctgggagggacagcctttccccctcttttgggagccagtctggcccctcgtgggatgatggtggcccccatgggctttttctttcacttgatttccctgtctatgtgtgtgtacccagccaccctggatcgtgggtgtcaccatggtatcctgtctctgagcaaacacatgagcgaaaaaacaaacaagcattaggaaggagggctctcccccacaccttggccacctatgcggagtgagggaccctgagccaggtaggaggagggaaggtgatggagattaaacagcaggtgtcagacagtcagggaaatgcgtttggattcacactggatggtcaggagccccaggtaccaaagtcaaacatgctgactcctgtggccacctggtcattcctcttgggtgtgaaggaggaggaggggagcgtggagaaaccaacaacttagcaaatgtgtgctgagtcccatgcatataggtgatgggagttggactcagagaaaagctgccagtaacaccccttagcaagcacttgctgtgtgccaggctctagatgacaacctttacctgctctctcgataggtcctcataagcagtccctagaggtcagtatcgttattgtgcccattgtacaggtggggaagctgaggcactgagcaatgaaacctcttgcccatgatcttacaactagtaaagtagcagacccaagaggccaagccaggctcatctgacttccatgccaggtccctgctaagattaggggtagggagaacagcttaggagctggggcaggagagtgcttatgtgtggagtagagaaagcccatcctagatggggaggtggcgggggtctaggtggcaaggggaaccctgggtgcctggcttcctcctgcaggcactgggaacatttgctctgctcacctcctggctctggatccagaggagtccattcctccaggtggctgctctcgcctgggaatggggtgggggtgagagtgaaggctgaatgtgggtgcagtgagtggtaaggtaggaaaagctgtgggtggctagagtgaggtcttggccccataggcaaggacatgcctaaagcaaacggacctttcgagtctcctgggtgatctctttcctaaaacccaccctgactctaagaactgtgagtgaccccagcacatctccttgctggcgcagttgagacagggctgtccctagctcatccaggacagttctgaagccgccctgaggctgtggtggctcaggtggaagacaatggcctggagggagggagtgaaatcctactctccaatcctgccaactagggaccctctctttgtttgcaagaccaaaaaaagaagaaaaaaaaaagatctcaggctattgtccaatgcttctatttatagctgccaaataattaagcggatcagcccttccaggatcagaaggggccatctagctggtggaccatatggtgagtctgcagggtcgcagagtggttaacaggagggaagagaggggagagagtttgtagagcctcttgttgatgttcatgcttcatttcttctcagtgtgtttttggtcaacagaaagattaaaaatagcattaaaaaattctgttctctggatataaccctgcgagggggtggggggactttggatcatatttacttgcttccctgatgacgcagagtgccaaattctaaagtccttaggatggaacccagctgaagacttccagctgaagtatcccccttcttccttctttggtcagtctctgaggagtatcatgaccttaacttcttgctttcctctgtcaagacccaaggactccttggccaacactttggggaatttattaattttctccctgcacccctagtgtatccagtgtgtcatcagcagacatttgggtcatgatgctcctctactctactgaaattcctctatgactccctattacttataaggcaaagttcagacccagcctcagctcacccttcctgcacccctgagccatcttcagtcgttcagggcccttcacctttccaaacatgagagctggccctttgaattttgattcttggccgggcgcggtggctcacgcctgtaatcccagcactttgggaggtcaaggaaggtggatcacgaggtcaggagatcgagaccaccctggccaacacggtgaaaccccgtctctactgaaaaaaaaacagaaaaaattagccaggcatggtggctggcgcctgcagtcccagccactcggagggctgaggcaggagaatggcgtgaacccgggaggcggagcttgcagtgagccaagatcgtgccactgcactccagcctgggcgacagaatgagactctgtctcaaaaacaaaaacaaaaacaaaaaaagaattttgattcttgctggaatgctttctgccctactctctcctgttcaagtcctgctcactctgcaaaagccagtgacatttaacctcccaggcttcctccaactcagaatgagctcacggtagaggggtttttttcctccccttttctggaccgttagagcaattttgtctgaacactttcatttgacaattaatcatgttctccctggcagcatctttcccactattatctcaaagaattatttaaatattttatcagcatttaaatcttcacttttgtcttgctccctcccctggaccgagtcttcctggaggtcagagagggggtcttgggcttctctagcaagcagcgttttgtggtggtcacctgtgcaggcttctgaaactgttgcccatgtttcacccttgctctgcctcttacttaaccctgtggccttaggaaagttttaatttctctcctcctgagttttctcacctatagaatgtggataaaagtcacacccaccttgtagagttgatgtcagtattaaaaacgtgcaaagcgcttagaccagggctctgaggtatctgctgagctccttagtatgcctctttcccctccacccagcatctggcccactgtcttgaacataggagatggccagaatttgcttgttttttttcctttggtgtggcgtcatttgtaaagctctgacccagagaggataggaaggtttcttaaggtcacatagcaagaagtggtggagaagctatggtgtcagaattgagagtccagcactcccagcccccgccctggccccaaggcctttcataggcagccctcttgcagggtctttactgtgcgtgggacactggagaaagctgctgtttatgctcgaacaacttttgcatgaatcagatggacttgaagattgccaccactctgcaggactccaggaggaccattcacattgcattctgtgggcatggtatccccttgaggtgtacgaagaggccccaggtgggaaacctccctgacaaccctcccatcccacgaatgcagctaaaagacacaggaggtatcagggccacagagtgagaataaaatcccactggagcaggtgaaagggctccgaagataggtaccgctgcccttttccgagtactgcctctcctgctgtcccctggccactttcagagagcccatgggttgacttagccttcagggtttagggagatattttggggtggtgagcttttcccaaatacccatctctccctgctttgagccaggggagaaatcagagctggttgggatgtgtgttgtgatgatgtgtgcagatgttcctggatcaacactctccttcctgcctgcccccttcccacccccatactccccagccacaaagggaatgggatgagtgggtttcagaagaggccaaattatttctaattcagaaatggcaacatctgggctccacctctaacgtactttctaggttgcttttcaaatggaaccaaaggagacaatctttggatagatttgtgatagagcaatacagtaaaatttaatgtttatggtataatctaggtgatgggatacaggtattgtctgtgaaatcctttcaacctgttgtatgtttggaatcttctcttctcttttcttttcttctcttctcttttctcttctcttctcttctcttctcttctcttctcttctcttctcttctcttctcttctcttttcttttctttctttttttgagagagtctcgctctgtcgcccaggctggagtgcagtggcatgatctgggctcggcctcggcctcccgggttcaagtcattctcctgtttcagcctcccgagtagctgggaccacaggcatgcaccatcaccccggctaatttttgtatttttagtggagatggggtttcaccatgttggtcaggctggtcttgaactcctgacctcaggtgatccacccgtcttggcctcccaaagtgctgggattacaggcatgagccacctgggccactacactcggccttgtttgaaattttcttaataaaatgttgtggagagaaggaataaggactttgtagtagccaatcctggctctgcccctttttagctgtgttaccttgggcaaattacttaatgtctctgagcctcagtttcctcatttgtaaaaatggggccaatcttacaacatatcatagagtagtgagataatacatttgaagtacttctttgtttttttttttttttgagacagagtttcgctcttgttgcccaggctggagtgcaatgacacaatctcggctcactgcagcctctgcctcccaggttcaagcaattctcctgcctcagcttcccaagtagctgggattataggcatgcaccaccacgcccggctaattttgtatttttagtagagacggggtttctcctaattgaggctggtctcgaactcctgacctcaggtgatctgcccgccttggcctcccaaagtgttggaattacagattcaggcactgtgcttggtactacgttttttagaaactggatgccaacagaaaaattagagcccacatgaaagtctagttttcttctggtgtggcggcccatgcttctagtcctagcaacttgggaggctgaggcgggaggatcactttgagcccaggagtctaaagctgtagtgagctatgattgcaccacttcactctaggcaacacagtgggatcccatctctaaaaacaaaaaaaattaaaattaaaccaaacatttaaaaaagtatagattcccaacttctctacactggcagcatggggcccagcattcacctaggtctgggtagcagctgcacccttggcctccgggtgtgtgatttccaggccaccataggctctgatggcccattcagttctgtgatcccagcctaactctttaaagcatttgagtttgtcactcctgatcgcatgcagcctcttactttaaggaagacgacccgagtcagccaggtaagggatttgcctgaaatcatctattttgtccacagagcatggtcctggccccggtgcaggcctcctgcctctgtatgttgtggcctctctttgtgggtgactagcccctgccatcagaagcccattaagctctgtgaaattcagaagcttggtccaatgggtcttggttgtggctctcagggggcctggggataggttaggaatgtatgtaacactgttttataaaattatcacaaaccaagttccccttggtgacttgttctgaattttctatccatgaatgtttttatatctttctgctccaaaattttacctgctgtaaaactatataagaacattaaaagacatttacaaaagcagtcataatcccaccaccatagcacagcagctgttcctatctttgatttttagaaatgctttcaatcacagaaaaggctattatttttatccggtgccactgacagtatattttaaccgaacttcctgcctcccatcctcccactctccccttcctttttctccctgtcttgtgcttttctttaccctccatcctttcccacctattgtccaccaggtactacaatccttccatcttacatccagagtttctggagggtacagccacacaatgctgctccgtggcagccctggcccaccctaggtaatggagttctgtgctctgtctggtggtcaagataaattccagatcctgggaggcagagtggggaacaccaggcatcagcaataagctagacttatggctccaggctctcttttccctccactaaagtggaacattttggctgaaggagtgtgtgtgtgtgtgtgtgtgtgtgtgtgtgtgtgtgtaaagaaagaagactggaatagtaggactttaggcaccaagaatcccctcccttgctagcctggcatattcagataattttcttttgatacctctgacctgtaataaattttaagctccatatggtcatctttactgtgtatggcattcttagcatttatgtatattcatgtcaataaatagttattgcactgtgtgccagaggggtatgttttagtagatggtgataacaaaatgcaaatggcacttccttaggaagttccatgtcatgtgctgctggaaacagcccctgcttctagtgctgtagtacctgtgtgaccttggccaaattacttcacttctctgtgctgtttccttttctgtataatggagattcttaaccctgctgggaggattagttaaatgagatactgtaagtgaagcatgtagcacaaagcttggcgaaccaatggtgcagagattccagttccctccccttcctttctctgcaagttttctttagtgcttgcactcctgccaaatggttagtaatctgttaacaaacacttaagtctttaggggtgctcagacgacaaagggttgcttttggagagtgaagaatcttcttgtaatataaatagtcaactccaattccagttttaaagtttggtacgccttgaattcaacctgttaagttagcccagctctatctggggttctggaaaaatctatccaagcctgatgttgcttgagagcagggcctgggtatgtggcctgtgaaggccagctttgctgtgattttcaccaatttccttacaaacggattttggaccagacttgtgcaagcttcccccagcaggtcttaggaacatctggggatccaattcagccttttctgacgttctctacgtgcagggcctccaccaagtcattgccttcatttcttaagggccatttggctgaacttcacaaagtggtggaaacacatattgcacacacaggtagtctaagatcgggaataaaaagattacaagtcctcccctttcataggcatctgggtcccatggttcatccaaaatgaagacctctgagctctgtcactgccaggtggatgggttgggtacattccctcctctctctctgcttttctgtcctcatttgtaacccgaagaccataggatataatgaatctgggagggccagaaactttggaaatctaattcagtcaacagacctgtgttgtttaggtgctgtctttcttccatgcgcttgatttctttgacattaaataatctgcttatggtgttataggacctggatgttgaaagaaatgttaaagctcatttcagctttatggtttccccacaccacaggtggtgtagcagataccttctagtgatatatggacaggaccctgagtcaccaaggagggatttagttcatttccagttttcttccagtctttctagttatctcagggagaaagtctcggtttactgtttgaacatctcttaacccttgcctgtctcccttttgaacaaaggcacagaacagcccccattgagactgcatgcaaacggaggcatctacctagaatttcataccctggttttgttttgcatttattttgaaagttttcttctattttgtttattttgaaggttatcttctatttcttcactggtgataccagtttttcacatgtggtaatgttacggagtatccttaagatatatttatttaagctgggtgcagtggctcattgctgtaatctcagcactttgggaggctgaggcgggaagatcgcttgagcctaggagtttgaggccagcctaggcaacagagggagacaccatctctacaaaaaattaaaaaaaaaatagccaggtgtggtagcacatgcctgtagtcccagcttttcaggaggctgaagtgggaggttgagcctgcagtgagttatgatcacaccactgccctccatcctaggaggcagagtgagactctctccccaaaaaagatatctttgtttagttaaaaaatttgactccattgaaagaaaaatgtttagtgaatagcataggagtcatgcagctagggcagaagttgtgatgggagtatgtgaataacacatttaagaagcactgatccagtccttcttctagattagtccaaaacccgctgaccttgactccatttctgaccccaccagtgacaaataacaagggggaatctcccactagccaaaaaactccttggaggcaggggtggtgtctttatcgtccttgtatttccagtgctcgacaccggcacttggacgtattcatctatttcacccgtattgatggagcacctgttcctcagcagctgtgttctgggttcgggggtcctgtagtgagagatgccatgtgcagcattgaatatcttcatacaaaagaatgtatgtcaatccataatggtccaagacatgcatcacgctaataggggagcctctcgcttaggagagggttgagctggtgcaggctggccttgagatgtgtgtcgggagactggttctctcagggatggtgttcttcctgaacacgatcttccctgttctgaccgccagcagctccagcccacactgtccagaacaagatacctcctttccacaggaacgagacacacttccacagcagcaggaagaatgcctgttctggtgcagtctgattttcaagcagtttgttcttctacagagaaaatagcctagaaggtgagaggcaggcctggctgcagatgtctagatgtgccaaggccccttgccagtggtcagcaggctgtagcgctggcctgagcttgtagttagtggggactgtggttggggaagccgaaggaagcttgaagctaggtggtgacgttgaagataaatgtcccgtgtgttgagtgaggaagggacaactctgaggttggggcgtgttggtgacataaaaagtttaactgagcttcctaaatgggaggcattctgtatttggctgtggcttgatggaattgcagttacccttgtggcgtgggaatcagcctcgggaccattaggatattatgatacagtcccttggtgccactgattggcggtgtcaaactcatctgtcaaaaaatgaaatcgatcagccaggaaggatgctggtgttgaggctgacataccttttgagcataataactactgtggcttccggtgctttgacaaaacctcagatacatggccttctggctgagcatctgtgatttcatattgttggcgcatttgttatttccctgggggttgcaaccctctgtaactttgctgtggctgaactaaaaaagaaggcatacacggattctacagaaattatgattctatgaaagattttgaggagatgaggtatctttcagagtgcaaagtgattttggaatataaagtattcctttgggaagaattacctagagatttgtcactgacctgtgttcttgaactataaaacatgaatatgtggcttaagaaatagtttttcttaaggctgggcacagtggctcatgcctgtaatcccagaattttgggaggccaaggtgggcagatcacttgaggccagaagttcaagaccagcctgaccaacatggtgaaaccctgtctctactaaaaatacaaaaattagccagatgtggtggtgtgcacctgtagtcccagctactcgggaggctgaggcgtgagaattgcttgaacccgggaggtggatgttgcagtgagcggagatcatagcattgcactccagcctgggtaacagagtgagactctgtctcaaaataaaaataaaaataaatagtttctcttgacaaataaacaacaaatttttaaaaatgaaatcacctttgttttgaaaaattgaaacttacctcatgaccattgcctgattcctgagtcctgctcctctctgaatatgaagttgcggagtctttttaaattcatgaacagatatccgtgatcttttctcaccttcagggaggttcaaggctccctaatctctactccatcccaatcatgaacacttccaccctcactcagtcccttccccctcaccattcatgaccctctccttcttccctccctgccccttccccctctgtaagtctctctcgcccaggtgtaggataagaaagtgttttgcaacctgtttggtagttttttaaaagttgaaagtttaatgatttgttgttgttttttttgagtgggaccagagtgtcccagccttaaatggctcttttgaaatgacagtatggaagaaacacaacattgaaaatggggacctttgagatctctgctgtctgggcctggctctgccaccacttccttgtgtgagggtgtatctggcctttccctttcatgggcctctgtttctcattgaccatagaagggatttaggtccctcatttgagtgagtctcttcatttctgcatgccagttggcttgttgctgtgacagtgactccaaagctcatcttcaggcttctgcttctgaagttcatgagtctgacactggatggctgtacttgggttccacagttgtgaaatggggaaataagagaagcaggatgactgcttgtttttgatggattttacgaagagcataacagagtaagagtaacaggtgagcagggccttcccagcctcacgcagtgcctagaatagtgctcataagtgactgattaagtgaaggaacataaggtgattctatgagttttgtgcaaagcaatcaaaaagcctcaaggaggcaaagtccctttggcctctcattaagcactactttatcccagtaacccgaaggtgctcagaaggggaaaggaaaggagagaggtagagtgcagctgtggctctgggagcctggagtcctgcaggtgtgagaggcttgctgtatgcttctcctgccccgaagctgagcatcccaacctccacaccctttgctgtgagcctttttttttttcagagatagagtcttgctctgtcgccaggctggagtgcagtggcacgatcttggctcactgcaacctctgcctcccgggtccaagtgattcccgtgcctcaacctcccgagtagctgggactacaggtgtgcaccaccacacccggctaattttttatattttagagatggggtttcaccatgttggccaggatagtctcaatctcctaacctcgtgatccatccgcatcggcttcccaaagttttgggattacaggcgtgagccaccgctcccggccttttttttttttttttttttttttttttttttttacaacagaccagacttcaggggcatgctgcaaatatctagcagttgctgctgcatttgtgttgcagctgccctagggctgagcccttagtctcaactcagtggtctgcaagctgcctgtgtattctttggactggctggagccaaggtaaaccaagagggggccccaggtctgccctctggctgagactcttggctgttcctgcatccatacactctgcttagaatgtcataaaaggattagagaaatccctaggacactgttctgttcccagggctgaaagaggattcctggaataccagaggcctcaaggtatgattacatttcaatccccatgcaaaattgtagaatgtcataccatccagtttctctgtcaatattagttctattgtttgcaatctgagaatgggagccaatctatggcctctccagtgcctgcttttggcaagagagaccatcaagagactgaatgaccagtcactgcatgttttctacctagaatgataggaaactggtcccttgatgtactgtcttcaggagggacattgggctggctgatctgagctggaaattgatcttttatctttctgaactggcgcaagtgaagagatgacagtagatgtgtcagggaagcggggagctgccatcctaaaaggagtagttccctgcagcctggagaggccagggtagtatatttcccaagaaaatcatgaagaggacagagaggattggggaggctttattgtgttggtgacgatctgtgaattataatcaaggcatgttgatggacaagtccttagcatgtgttgcctaacagtttattccttccacctaacttaatggaggcccactctgtgctcgccacaatacaaagatgtattgcattgatacaaagacgaatcagctttagtgattctcatgggagttgtacttatagtagattagcaggtgcatggacatgatgtaagtggatggcgcctccttgcaccctcccttgttatgaccactgtgaggtccttctcaactatgtctgcaaaaagtgcctgctttgtctgttctcctggggaacagaaatgctgatgtttccctaggcgttgttcctaggtgagtattctggatggtggtggtggagcctataaaccaaaacatgtctgaaagagttctcaatcagtttagaggttcattttgccaaggttgaggatgagcccaggaaaaagagataaaggctacagtagactctgtggcctgtgctttttccaaagagggttttgagaacttcagtatttaaaggcaggagagtgggaaggagcaaaaagagggacactcaatagtgcattcggctcctgctcagtaaatcttgtattttacataagataaagtaaacatagagtagaggaagaagaagtcagatctgcatttgtcttgaggtgggcagagggatgatttctagtcttgtctttgtcccttacctgtgaagatacattgtcagggtgagagaggctacctggggagataggtgaccttctctcttgcagcaatctgtttaggaacaaagagaaagcagcttttgcatgacaaagttcactctttcttttggcatagtgagttgagggtcccaagattttactttcctttcacaaaccaaattgtgacatggctgtgagaggatggtttcttgtatcttgtatcttcttgaggattaatctaaatcatttgtgtaagagaaggaggtagactgggaatcaggacttcagcttctatgcatggctctgacactcatctcttagtaggattttgaaccctgacttgcttattgcttcagttcctcttgttcaatggaaaggttgggttgcctgatatatcatatatatacatatatgatagatacatattaacatatatataaatcacaatattctttggaacaggaactctgaaagatgcaaatataggaataaaggggttttgtttgagaaagcttgcaagatgttaggtcaaacaaaacaattaaatagtgttcttcttattgcagaactttttagggcctttaatagactactatggggaatttccaaaagagggtacaatatgcagtgattctcaaacttagttgaccatagaatacttgtgttggggagaagcttatgaaattaatattccttggaattctactttgggaattgtaagggtagaccagcgatgttcaaatggtggcgattttgccctcgaggggacgtttggccatgttgggagacattttagttgtcacaattaaggatgggggtggaatggaggagaatagctactggatagatgccagggatgctgccaaacctcctgcaatatacaggacagcctcccacaacaaaaagtttatccatctagccaaagtgacaattgtgctgaggttgagaaaccctgaacttaaaacccccttctgttcctggctctaacacttgggggattaggtggtttggtgacccttccgaacttggcataccagttcaccctcaggcatctttggctcttgaactgtatattattctctagaaggcaggagaggtgaggcctttcatactcatccctgcagacctgcacatttctggcaccagacccatatatctatatatctatatattcatttaccacagcccagcattcctggcagcctgagagctggtggctagttgagaagaacatttagtctccctttcctgggtctcgtttccacccctagtggccaagctggggcagctcgctttgctctgtggtctgacaaacttggatttcaaaacccactgcctgccaggagcagttcccgcagacagagctcagattccaagaagactatctggctcttagagatccatcatctttatgaagttttaaaatcacagatggtttttatggatattcaaggtattccagcctttcatgttttctcttcatccctctttcttccccaatcacacatttttctccagtaaccaaaacacaataggtaatggaaattccattacaggctgacccacagagactgcatgggaccaatgcaattatgtctggagcaaagcactgtcatgactaattagcctctcacataaatgaattttcctatggataacttcagaaaaatcagcctgcaaaacacactccttattagttttccttccttctctgggcttcggagttaggctttccctaaggattctctccaccactgggccacgtgaacagtctagcccatggtggaaatccattttctgcttgctcttcaccccctcagtcctgtgcttagtttcattagagactaagtctcatcagagacctcgttatttttagggtgatgagctatttattgagcaacttgcttctctcttggaaggcaacataggcagtgatgagcaggggctctgtcaccccagctctgcactgacagtaactttgggggaaccttggagaagccacattgggacctcctggttttgtcttcccacctgtagagaggggcattgtccttgatctagagatatcagctgtgattgaatgagtgtaattcacggagcagactttattggccactgaatttagaagggattataaaacacatcttccttcaaaaggatgcttagagctgggcatggtggctcacacctgtaatcccagcactttgggaggccgaggcaggtggattacaaggtcaggagatcaagaccatcctggccaacatggtgaaaccctgtctctactaaaaatacaaaaattagccaggcgtggtggcatgcacctgtagtcccagctactcgggaagctgaggcaggagaattgcttgaacgtgggaggtggaggttgcagcagtgagccgagatcatgccactgcactccagcctgggtgacagagcgagactccatctcaataaataaataaataaataaataaataaataaataaataaataaatggatgctcaggattggatgacttattgggcaaaagcctgggcccttgcttaattggttcagacatttgttgagtgttacctatgtgctaggaagtactgctatttcttctgaaggttgtagaatctctaaatatagagacaaaaagagaggggagggaaggcccttgtgaggtgttagcaaagacctcccaccaccactgactggcactgattcagtatctgtatctgggtgctgtgccaagtcatctccacatctcagctaacaccctctgtggtgcatattgatagtgcccccttccaggggagggcactgaggctcacagaggttaagaacccgtccaataacatctgagttagtaactagcagaggtgagatttgagctcagttctatcatactctaaagcaagcctcttcactctgtgtctgctgtgagcattgttttgaatgggtccttgattcccagcctgtattgactttccactgcctgggtgctccagccaggctcagggctctggggaatatataagtgaccatctgggctgggacagcaccatgatgctgatgtgcaccaggaagggctgcctttgggaagaattgctgtgcactgcactcagaaattgcatgtgctagatgttggagctgaactcccctaagaggaattttctaagtggattatgaaatcaatttagtgagttgtaatcaatgttaaaaaatacaggatatcaaagtacattccatgtaatagtgtaggtattgtttcatgaatcctgtgttgcaattacttgtatagtaggtatgtgtgggtcacgatgtaaaatgtatttcttactttgggtccaggtcacaagttggaaagcgtggccctggaaggaggtggggcatgcagcagtgctgcagagggaggtgtgcaggctttgccctttaaggctctgctggggatgccttgaagaaggcagagggcacagcaagtcctggcaagtgggtcagcaaactcactctgactggctctatgaagtgctgcaggggcttcagagatgttataggggaggcccctaccatttgtcaagaaagtgggagagagactagctctgctccgcaagacaagagactataatagtcaacatctacaagaataataacagcagcacactgtatccatctttaactaacacgaactctagcgcagactgtctggatttatatcccagctcaacctcttataactgtgtgacctcgagtcgttcacctaacccctcatgcctattttcctcatccgtaaaatgggcataataatagtacatactacataaacttgttgtgaggattcaatgagttactatttagggagtgctcagaaccatacccagtagacagtcatcatatatacatgtctgttatatacaaaaaaaagtcatataagctttatttgagtgcccaatagaaagctttaccaaggcaagacttgaagcaggccttgaagattactccattggatcttcttcttttcatctctgtcatcaataactgtttatttcaggggccataaatatgttccagacactgcagagtccttcacgtatgtcctacagtctggtgaagtgggactcatatgctcattttacagatgaggaatgaatatttaaagagagtccaagccaggccccgattattctggctgtgtagtctgtactcttgaatcagacgacacagtccctctttggcctgccatctgtgttgtactggggtctggagatggttggtgtcctgttctgccccttgcttagcttatcctctctcagcctcagaaaccaaggccctgtgtggacagaaagcaccgcgatgaacacaggtgcctatttgaagtgctctgttgtcccagactggaggccagcagactcctaagcaggatgtgtcacctagcagagacccatgcatttttaaatgtcctcctgcctttggagacaggtcctgaaaaaataccagaatcattaggactcttagtcatccagttcagccttggggagctgagtatcacagccctgttgtcagcagcagaagtcctgccacctggacaaggctgggaaggcagcccacattgccgcaccagggagaccccaagaccaatgcctctggggtcgatgtgggatgattggtggttgactgatggcaataaatgaggacaaggagaaggcagggcccctcagctgcatgccatgggcaggtttcaaccgagtgtgggctacatgtccagatctcacccaagcactgtggacaaacatgaaggagaaggcagggctgctgcccacatggggagtctcatctatttggggagataccagtgctcagaagcctaaattcaagtgctgcaggaatccagggagggggcatttagggaaactggggtggttgtgtaaaacttcccccaaaagagaaaattcaggtgagggtaaccaagatttggagtgactacaatgttaaataaatcggggcaatgtgtttatagataatgtgctctccttctgcaagctgccaccagcctgccaatacttatatcctcatccatccatccatccatccatccatccatccatccatccatccactcatccatccatccatccatccactcatccatccacccatccatccacccatccatccattcatttattcagcacatacctcccaggtgcctgccctggcccaggcccagtgctaggccctgtgtagacaacgagcacagttgcatgctgcctctccttcctgctcatggtctagtgtgggagaccagcattgaacaaataaatcagcaaatagctgtgaaattaaaatcacagtgagtccaacaaaggaaatgaatgggttgtgatgagaaagaacaagggggccctaatttggactgaaccaggctgagtgcatctgtcaaaatcatgcctatcctttgaggctcagcagaaataccaccaccttcattaaatcagtctgttcctgccatttaacaggtcctctgccatactctcttcctccctggtgtcatattctaccttgatttagttttgggtacttgtctgtttcccctgagagatcttcaactcctggaaggagagattgtatttttttttttgtctgagaacctgttgtgagtaatcctctctcagagatgcccaggtgaattgttgaatgaatgaatgaatgaatgaatgaacacagatcttcattcctagccccaggcttccactatgggtatatagcagtccctgtggtgagagcaccagctccagaatcagctgcttactgactttgtgactgtgggcaggtgccttgacctctctgagccttcatttgccatatgggggcagtgctataaatagttgtaaggatggaaaagattagggcatgtgcattacttagattcatacttggcatataatgctttataagttagaaggaatgtgctagacacatccaacaactctcagaatcctcacaaatctgctgcaaagcacttataattattcctgtattatagctcagaaacctgaggtttcaaaggattaactaacctgctgtagtttgcagaataaattagattttaacacaaagcaaaacaaaccaacaaaacaaggccaatatgcaaacctgggattgtctgactccaaaagcttgtcttccttgacagtgtcccattcctctgccaagctgaattctcacctctgcagacagaggctgagatgtttgcattttggaagctcaccgcctggccaaaggctaacatattgttcatggatggactggacatttgaaattacatgctggccttgggagggaagagagaaggaatgcttgacttccacggggtgcctctgccttacccatctcaaagaatcagacccctctctcatttttcaagggccttggggtgagcatcctaaaagtctcacagtctgttgcagcagaaagcgtggctttgtcccccctataaaacatctggagattttcaagtttgtgcagaccccatgtgagcagccagccctgggttggcatggattggagaggcagagaaggcattcacttggctctgatttttcatcctgtggcctcagagcttcagaatacagagtccctacccctggtgtctccttcctctccatccaccatgacaagctgtgtccacattctctttttggctctttcctaaggtatcgggcacaggactatgtctgcccaagaataaaaattataccccttatatttccaaaaggagaggcatataatttatgactaaaactggggtactctgactgaaaatatctactgcttagccgtttctatgtcgattagagaaggtgtttatagctcagaactagaggagaagaaaccatttctttgtcactgagaaactccttgccagggtctctcagtgagaaacaggacatgtggagcccaagatagggcaaagccaagtctccttatcttatttagtgacatttttttaagagtaaaaaataatcacatgctttttgccaaatccagccctaaggcatggatccaacaaaacatcacattaattagataatctaatttccaaaaacagaccccagcgcagacacccactgtctagcagtgatgacaaagggatcagacagctgacatcgtggcttcctccttcagagttcatgtggacacctaccaagaataaggccttggccagagctttatctgtccttggactagaatgtttcttagtgatgccataacaacggggttgacttaaaacaatgttaatttattgtctcacagttcagaaggctggaaggcttaaatcaagatgtcagcagggccagcctccctctgaagcctgtagggtttctccttccttgcatcttccgtgtttctgctggtggctggcagtctttgacttgcagccaccactccagtctctgcttctttggtcatggggcgttctccctatgtgtgtctctttcctcctctcctagggacaccagtcatattggattaggagctcaccctactccagtatgacctcattttaacttgattacatctgcaaagaccttctttccaaataaggcttaccttcacaggaactggggattactattgaaacaaatcttttggaaaaaaacactgcaacccattacaggtgcctaagactagaaagatgggtcagagctgctactgccagtgtgagaaagtggacaagttggagttcacctgggaataagatccttggatggaggagcaaactccagctagaggaccgaagccttgaaatcatttattctgcagatcagtgtttctcaaaacggggttcccctagccatcagcattagcgtcagctgagaaacatgtaaggcatgtaaattcttatgctccaacctaagcctactgaattggaaactctgggctggggtggtttcttattttaataagccttcctggtgactctgctgcacactaaagtttgagacccattcctctaaattctgccgtctctcctcactgcatcacttttcagtggggctgcccttggacactggcagatattttgggttaaagaagaaagttatttggtcaaaatgagtgtgggcagcattgtattggtctatgttgaacaggttccttgactgaaggctatctctgagcttttgctatgctgtatgcagtgagcattgaacatttgttagaagaggaatgatggcatttccagatttcactgcaaagagaagtgtcccttttgtatggagtttcccatcagactggtgttccgtgaatttacactgggaaacatggctctagtccacatatcaaggcattcagtgaatttttatgaaccgccttgtgagaacaagacactgtgctggagagatacatctgtgaacaagacgtggcttccgtctctaggaaactgatagtctagtgcaggagctggcacaccacaggctgtgggccaagtctggcctgccatctgtttttgtatggcccattagctaagaatggttttcacatttttaaatagttgaacaaaaattttaaatgaagaatatttcatgaaacatgaaatggtatgaaattctgatttcaatgtctctaaataaaattccgctggaatacaaccacactcctttgtttatatattgtctaaggccacttttgccccccagcaacagagctgaatagttgcaacagagaccatatgctaaagcctaaaatatttcctatctggccctttacagaaacaatttgcccacctctagtctagtgaagcaaagaggccctgaacaagtacttgcaaatgccttgagtgttatgaaggagcagtgcaaagaccacatgattggaaggttttattgactgatagcaatggtggtggtggagtggaggtggagggtgagttaggaaaggcttcctggggagagatcttaaatatgagtaggacatctggaatatgactgtgtgaagaaggttgttacaggaaaaggaaacctaggacatgcagatccctgaattagaaaagaggagtgctcattgaaggaatgcaagaatgtccagtattgctgtggattaagggaggtgaggccaagagtatttcagtatgtggccagatgcctggcaaaggccagatgtgccagagcatcttcgacggccatgctgagggccttaacttttgcctaagagcaagggggagtccctgagaagagtttaagcacaggcatgatgtgactgatagaaaccttgtggtatctctctggcttcagtgtggagaatgaggggcagaactaagtgggaattgtaccattgcatgatacaatgtaaatgattatgaagcttaggagtcaaccaggggagagaagctgagatggagagaagtgggtagatttgaaaggtgaaggttctctgtgatgcttggcctccctcctgccaggccctttgtgttctctgacaacctaaagaaccttccttcctggttactgggtctgtgctcttggaccctgatatattaataaatattgattgtttgttgcacacctgctacaaatccaccaggcccagtgctagatgctatgaaatataagaattaataagccctggctcctgacctcaggttcttagccgggagactgatggatgtagccactggactagaatgtaatgaggactgataagcagagaaacaagtgatatctgaggggactgatacctgaaaggaagtattgagcaaacagccctggagacgttagctctactgaagaggtctggagaggcttcatggcagaggcagcgtttaggctttctcttaaacaatgtgtaggatttgggaaggagaacagtggtcattaatccaacatgagcacaatgacaggtctattaacagcctccggtgggtgcaggggaggctaggggagccatgtggctggcatgagccatcagtggaggcttacagagagcaaagaggtgctcctgttttggaaactcaatctagactcctgattgcttcatgtgcctgacagttcagtgaaggctgtgctgggaccatgagttaccctcagcagtggatcagcagggcagcagaagacccactctttcactgatggccagggccctgcgtaccccaattcacttcaggcccttccaaggcaggtacaaatcatgaatcacattcccctctctatgactttgtttataggcagagctctaaagctgggataacagcaaactgcatcaacaagttctctggggcctctagcccattgatcctatgacttgttgtgattgcccctgacctcttcactttcttcttcagtttggtgctttggccactgggaccaatgacttccactgaagttttctggttctcagtcctgctttccagggctgtgacacagggtgatttgcagactgatttctgtcctgtgccagaagatacttaataaatgctggcaatgacgatgggtccctgaagagcagtttgcccaatttattttttaaagactttaaaaaaatagtatagacagaaaagtctataaaatgaaaaattacaaaatagcaaattattatagaaaatttgtgtcactaccactgagttcaaaaaataaaatactgtcggtatccccagaagcttccctgaccatcccttctccttggctggcgtctcacctttgacgtctcaagttcaagaaatctgagtaacaactctttctgcctagcttctagtaagaaaaacagctgcaaaaggagaaaaacaaaacaaaacaaaacaaagagacttgggattcaggtaaccacctgacctttcttccggatctgctcctccaaaaaaggtctccatccctgtcagtgctaagggctggatggttagttgttatggagacgtggggcgtctttccaagacgccagcaaagttgatgcctgcagcgctctggcaggtccctctgctctgcagggctcttctctccttgcagttggcagatccttataataagagacttctgagatgtaaaaggaactctcccctcatgtgaccttcatgccagtccccctggtgccaccccacctcagtgcagtagctgagcagtaacagagggacagccagtttccctctgtccaggggagattgtgggtcttcaggtgagagtgtggcggcactaacaacagcctagtcacaattcattagtaaacttggcattcaggttactgacatttttgcaaactgcactttctaacaattaccctctggttaaaatctgtatttgtagaaggaggccagtctgaaaaggaatgaggggaagaacgacttcccctggagaagtctgaatgaggtggccctctcttctaaaagaaaggtgtgtgccttttgagatttcaattattgagccacttccatcgggagctcttcaattatttatactgggtgtgttgcaagtagattcaccaatttagaaagttgggggaaagaggggacatggtaggagggaggcccccgtggatgcaagtgtgtgggcaagtccttttggcttcctcttggctctttttctggatccaacttcatcgtagggctggaccagccactttgtcaagggtatcctcctcactgaggtctggagatggggacagggtgtggatgcccctgggtgtagggaaccgacacttccagacactcggtgagctctgtctgggtggaaaacctcatcagaagccagattgaatcacaccagtttctaagacattcctcaaccatgttaggcaaaagagtcccccactgacaagctggggtagaaggaaacctgatataattttggaaaaaaaccttacttgagaaagaaggttctcacagctgccgagtctctctcgacgtccagggttggaggggtcccaggccatggagagaagattgatgggtctagcggagccaagtagagagttgaggctttgcagggccaggcgcttgccatccttaactcccattagggatcgagaaggaaaaggagaaggagttctctgaatccaatggaaaaagaagtcctgtctcctttccctgggctgttgaattgtttttatttcacattagcaactgctctggactctcttgtgtttggctgctgtgttggagacctagatccaaactagggtgtgtgggaacccagggacatagaggctgaagttttggaacccagccagttcttccaaggggtgaggtcagaggcagagtccagggagcagggcagctctgggagcctggttcctcaggctgggctgtgctcggagcggtagatcctgactgccgctgtatgcctggtaacctggccatctttctgcctcccaaagtctgtctgtcttgctagcccttggtttcctgaatggggatcatcttaagtgtggggaaaggctgtctgacgacctaattgggacagctcttttgacccgaagccaagccccatccaagttcagcaaatggaagaagcgggaacatgttcagttggtgaggtctataggcacagactggattaggtcctaaatcatggtggaaattttcctggcacgggacaaatccttttgtaaacaagaacattcatctttcttttgactgacatgcctggtagggcatgtgcctctcagaagctccatgtcatctgatctcatttgggatttagtgtttttatttgaaaatgtagctgccctgaggaacagcagttaggagccaacccccagtttaagcttcaagtcatggaaactggcctggtttacccagacgtcagtgatgcctgggaaagctcttgcttttccagtgcccactgagcagagatttaatttactcaatcggtacgtgtctgttaagcacattgctgtatgccaaacactttgggcataaaaggtatataggccttgccttcaaggattgtccaggctaactggggcaatgcaacatgcatggaccaaaagacagctaagtacctgtcccatgtggaattgggggagcagatgtgggccctggagacaggacagggagagctttggggagatctagccaggaaggagaacttcactgcacctctgggatttgatcagggaggatgaagatggttggggagcaatggggagagcatcccaggagtgggaacagccagcacggaggtgtggcagtcaggaggaccaagtcatagccgagaagtcaggtggaagagcaggtcagtgacgagtggggagggcagccggcagcctcagctccaggccttgaagatcaggccttgaggagtttgacttctatgcttagggcattgtggacttggcaggatttttgagattccagaagatatgagcgaagagtgaaaacaaagcaggacagaacaaaaaacagaatttcttcatttattatttcagtgcactgtgaaatgctcaccgtgtgctaggtgctgttcaggctttgaggatgtggagtgggcaaatcaggcagactctgccctgactgctagagaataagcacacgtgtgtgatgaaggtggtagtggtgggaagcaaagaacagcagcgaaggggatgaccgtgttcccttccgtgtggggcactgggctgtgacttacattgctctcgggttactcatctttttactccaaattgcttggagtcctctgttgactctgaagggaatattcaaccataaacaattcatcctatctgctatctgtggttgaattctttcttcccagttgccccttgggtggtggcttggggccacggtaacacttgtagtatttcccgggaggttgttatagttctgtgcatttcctgcagtagtggtagtgaaggcattagatgccaggaactcaggcggttggtatggccctgagctctgaaaatgcttgccttcccctttcccctattgtgtgggccagcagcttgcagagctcctccagccctgagagaccatgcctccatccctcagaccctacctttcctggccccaaggctgcctctggctagtgtgacagacacaccctgggcccctgaagtctgaaagccacatttttcgaggggaacctggccactatgagtgtggaatattggggccttaaatttcctgcctgtagaatgaggcatttgggctaggggagtggttcctagactttttgtgggataatcaatgaatttttataaaacagaatatcacaaggccaccagctttttattttgacaagcaaaaacataaaaaaagaaactgtcaaatgccagctctgccaccattgtcatttcattaaaaggacatgttaatacccaacaaaggagtaacgatataatgtcaaagaaaaggacagttcttcctgggagaggcccttcatcagttgtcttccactgacacacacagtgcgctgtactgaggcttttcattccgtaccacatcaggggcagcactgccctgtggccatgcaggacccatgggaacagagcacctgtgagctacctgcaggagcctttgctgaggagagtgaggctccttgggggctggatcctcctcctggtctacaggatggcaatgggctccctccggtaaaagttaacttggcacgaagatttctgcattcttttatgaacatgagggtttgggatttcctgtgtgtttggttatccatatcccagtctgccctgatgagaaacaaatgtaatttttgccttcctgctgggcccctgccacagttttcttgtctgggcaggtcttgagctgagcttctggggcaggatgggctgccctgcagactggcagctgagtctccgagtctctgatggacagcaggctgtcttggaccctgccagggtcatcctggctgaggactctactaatccaattcaaagtctctatggctctgatagtggactctggactgtcacttatattttccaattttattaagctaattgaaagggaaggagattgttattttacaaatatggcacattggccaggatgtatgtattagccctgaaagtttggaggttgccttactaattttaggcagcatatgtggccatttgagaacatatctaatgtctaatgagcattgtattcccaggttggatccccgtcccctagcccatttctccaactctctgtccgtacatagtggattataactgaatttagatgtctgtactacaggattttgttacttagaagccataggttgtgagatggttgtttcagtagtagtagtaaacagaattttatatggagattccatctctgttcttgcacattggacctatcccaagacagtgtggaatagagagaaaaaatatggccttcagagttagaatggactagattgaaatttcagctctgccacttacaagatgggtaatcttggaaaattacccaatctctctgagcctcatgacattcctaccttgcagccaggcgtggtggctcacgcctgtaatcccagcactttgggaggctgaggcgggcagatcacttgaggtcaggagttccagaccagcctatccaacatgttgaaaccccatcttactaggaaaaaaaaaattactggagcatggtggtgggtgcctgtaatcccagctacctgggaggctgaggaggagaatcgtttgaacctgggaggcggaggctgcagtgagctgagattgcatcactgcactccatcctgggcgacagagtgagactctgtctcaaaagaaaaagaaaaaagaaaaaaagaaaaaacattcctatcttgcaggcttgttgtgaagattaagttggtgtaaaatcaccaaggacagaacacagtagatgtaagaggggatcagtgatctcctgagcaccagttgacccccttggtcctcagggaatgggagagcagctttgaacctggctctgagaagagctgaaaaggaatctgtcctgcagcatttcccgggggagggaaatgatgcttgattgacttgcccagggttacagagctgagacagtgcgtgcaaagtaagggacttaacaatccaggcctccgggtcagacagtttagagctggacagaccttggggagtgtttacatggctccctgcatttgagacaaagaaacctgaggcacaagatggtaaggacttgttaaaggtcacctggcctttttctaccatgaagacttccaaagagtagttgttcacacccagcgcaggggtgcttctaagagcgagaatctggacagggcacccagaaagcaatggctaaaaatgcctcaatggtggagcactgtaggtccagctgagacaaccagtaaactcacagggctttctgacagctcggggtaatcggttaggtcccagcttctttataagttcctgttgcctgaatctgtggacagtgtgtcccttccctaaaggtatagcccacagttagcaaacacagtaactgctaggtgaattaatcagtgcaaatgtcttaagccctgctggtgcagagtctccggggtgcagagcaggagaagtgatggcagccagggagaggttggactatgcaacttcccaggggcagaagtgaactctgccactcctgacaccagctctaggaaagacctgggtcccctgttgccctatttctctggtccttgagtctcagagtaaccacctcctccatccattccctttgcagaactcttgccatgaaaaccccagctggtggtgcccatgctatgcttgatttgcttgagctgctttgggtaatctgcctaataccctaatatgcaggattattggtacctgggagaatgcccgtggctgggaaacccgcccaggaggtgaaagaggttgctgggtggatgtcctctttggcatgggaggggggacacggaagacccagccccagcattcggggctggtgaaaacctgaggcaaaggagaggagagcagcccgcggggagggaccagcagccccagggcttcctaaggtattgaggttcagacacttctggatcttaggccaaactgtgccacaggatgtcatagttattgtcatgaaacaaagcattttttaaaaagctaacatggggccgggcgaggtggctcactcctgtaaatcctagcactttgggaggctgaggcaggtggatcacttgaggtcagaagtttgagaccagcctggccaacatggtgaaaccctgtctgtactaaaaatacaaaaattagccgggtatgatgacacacgcctgtaatcccagctactagggaggctgaggcacaagaatcacttgaacctgggaggcagaaattgcagtgagctgagatcacgccactgtactccagcctgggcaacagagtgagactctttctcaaaaaacaaaacaaaacaaaacaaaacaaaaaaaagctaacatgggcctatggacttttactcaggggatttctaatgtttttccccagaaaatcccttcactcagatgcagtctagcacagaaccataataggtgaaattgctcaatgcagaggcgcttttatttccgcggggtccggggccctgcctcctctgccctcccttggtaaccagcccccctggggcacctcacaatgctgggcctcaaggtacagaaaactgtggatttaactcaccaccccctctcgtctcccagatagggactcttctcagagaggttaggtgactggcccagggcacacagcctgtgcctggcttcatagcttctggtccagaaggcttccccctgcccccaccctttggtaggagagaaggagcccttctgcattgtgcccagttgaggacagcagcatgtggggctgctgggtcagtttcaacagacgagaggagatggggcaatggagtggccagggagagggtggggtggggctcctggcagatggaatgagtaactcagagcgcagtccatcaatgaaggctcaggggaaatggccttctgatgttgaccaggaaaatttgaggacaaaggggctgtgaggcatgaggcccttccttctctcacagccctctgggggtcaagcatcctgggactatcccatggttccagggtgctgggcagaacatccagcttccagggatgagaggggcttcccagcccctactctggtcccaaaagggctagcggagatggttttgtgctaacctgatctctcctgttccctgtcagaaccctacctcccactcaggtgcgtcaggcccggcagagctcagcctcttagtgctggagaccgctgggcagagcgtgctaaggactccaaggatacgcatggcgagggaggaagccaaatcttcctttagcagcatctgcatagagaaccgtggttcttagcaggagggcttcacagcccgtcagcttggccacgctcatttccaatgtgatactctgctccacgaagggtgaatttatggttccgggcaggttcttggcagagaaaggaactgtgtttctctgtccttgatggaactgccctccataggcacagggccctggaagaagggtcgtgatggtacaagcagtacccagaagtggcatgaattgagtgctcttcatgttaataaacctttcgtgggcactttgcagcagccaataatccttgcacatgcattctcccgtctgctgctcacactgttcccgggaggacagcaggatgggtacgtgtccctttttggcatcagacagctggatttaaattcacactgtgtcttcctgggccagctacttaacctctcatctgtcaatggaggacattagtaccaacgtcatagagttactatgatcatgctaaaaaacagtagtcgatagtataattattgttagtagtactatttactagtaatatctattctagattgtgcatggtaagaactgactttccatttgctgtagctctcctccctcctctcctccttcccccactccttccttccctcccacccaccaagatttgtcaggtgcttactctgagctcacagggattcaatattgaagatacagccataaatgaaacagacatggtgaaacccccatctctactaaaaatgcaaaaactaaacaggtgtggtggcacatgcctatactcctagcactcaggaggctgagacaggagaatcgcttgaacccaggaggcagaggttgcagtgagccgagatcacgccactgcactccagcctgggtgacagagaaagactctgtctaaaacaaaacaaacaaaacaaaaagaaacagacaaaaactctttccctcatgcagcttgcagacagcacacaatgatgaagtaaaggaagcaggtggcagacacactccggagaagacagcacagacagggagaggtcgggatgaggtggagagctcatggacaaagtgaggatgtgaaccaaagctcgagagaaatgagggtgcagccacggggatctctggagcagaggcagaggccagtgcagacagccccgagacgggactgggtctggaatgtcctggcagcatgaggaggccattgcatctgaagtggagctagtgagcggcagactcgcaggatgacaggcacgagtggggctgattgggtgtgaagacttcacttgtcctctgaatgggccaagaagccataggagggtgttgggtacaacagtgacatgatttcagttacatttttgaaaagtatttttcttcccagatggcctttgcctaaacaacttcccagatcctggatgaggaaccagtgtccaaagaactgacacgtagttaaacccgaggcagacttggagcttcaaggcttggctctaggcaggcagcagggaggggccctgggatcccctcaaggcgggcccagccagcttctcatgcctgaggcagtcatccagcaggtgtggtgcctgcagtgaccttggtgcctggttcagcttgacaggtgtcaggagtgtgcctgggggtgagagagtccaaccgggtgagagcaggtgtggcagcagctcaccctgtcagggagggtgtgcccagcatgacaggtcacctgctgagacttggcaatttgacatcctgttagggtgcagggtgacaacgggggacctgccctgcaagttgcagctgggtaggaatctgagtgttgagccctgcgttctgtgagggctctggctttgtggcacaggacttctttctccagagcagccctgcttcctgcccagaaccagaggacagtgactccacttgcctgccgtttgtaaagcagttgctttcagaaaggcaatgctctgttaccagattagggctcctgcaagaatcaggcagggtgacaaggcaggactcatccctgttcatagaagagaatatggagggtttgaggaatgacatgacttgctggaggccacccagaaaagttggacttggtccagagtatcttttgattttcatagttcttcctgccacaccacagacctgagagtcccagtatactgggtctaattcagcaaggatgagagacggagacagccaaatctgagggatggggctgtggggtcctaggattagcacaagcttgctctcctgtgctagaccagagcagctgtcgtggctggggaaggctgggccctttgaagacaagcaggattagcccttgtcgtgaccctcacacctgaacccagtaccaggctaggtggagccttctgccagtcctaggaacaccctgaactccaggttccaggctggggcagcagagtgactgtcacttgggctagatttggagcaattgtcttatcggggaggcaacaagagataagggaaacagagcaactggggcttgcttcctggcccggtggtcacctggctgggctgggtggccctgagcttgtggctttccctctgggcctcagttttctcatctgtacactgtgtgtgtggtagttgggtggtggtggggatcctcaggaattgctaaggtcccttctcaagctttggtctttgatcttgtgattcagcgggaaatgcccaaacgcatcagatgaggtttgtatcttgagcaccaggtgatggggtgcagtcaggcccttggccccaggtgacataggaagggtgagcccctctgcggccatgtcaacaaaaagtcatcgtggggaacaccactaaagggaatggggagaaggcatagaaaggggtgagggtgtaaggctgggcacagccccgtgagaggttgcctggtagggtgggtgtcgggaggggactgtggccactcttctctctggtgttccctgcctcctgtgcctgcacccttgccctgaattcctccccaccttctgatgtgggcactgaaattagatgtcactgttgccactgagaggcagctgtggcctgctttacacaaggctctagtggggagagagggcagggttggaggcagatccagagtggcctccagtgcaaggccgaatccctttctcagggagctgccaagggcagggggagggctcctgcaggacctcctctttctgagatggcctccccacgcgatggcctcacctctcatttttctccctattcttccctccatgttcctttcttttcccaagacatcttttcttgcatttcagaagatctggtggcctgtcctcctgaagctggggtagctggaggctgcagccagtggggtttctctcccttacacacacagacacacacacgcatgtgtgagcacacgcacagatgcacacacacatgcacacattctcagacatgcacacacacgtacacactcacacgtgcacacaaacgcacacacacatgcacacactctcacacgtgcacacacatgcacacactctcacacatgcacacacacatgtgtgagcacacgcactcagtgatttcctgactgacatcgggctgcccctactgggaagtgcttcctgtgtaaggacagggtcctctgcagtgggaggtggaaggtttgggcgtggctgcatatcccctttgctatttggaacaaaccatttgttcccctgtgaggcagtatcctgtggggccaggagcaagaacggaatgctgggactcaggaggcagcctctccctggtcctcagcgttctcatcttaaaaatgggaggttgatctaatggggcgagtcagaaggggtctgagatgtcactgggtctggggtccaccctgtgcgggaatccctgccccagctgtcctgggtggtggtcacacagcgcctactagaagccctgcaggagtcacagcaccttgccttatagggacttcttgctcattggaggataacagtgttagaacctgcacctccttatcctccattctgtgattatttattaaaggttcactctggccagtgtgcctcccagggccactggttgatgaaagtggtgcagcttcagtggattactcttagaggccccagccccatcagcgggtgcttcatcagggcagctgtaaccactgtgtgcccgggactgtgccaagcttcagcttccccaccaccttaatgaggcggcatgtttgtccccatcttacacggaagaggctgagactcaagggttgatgggccacagccatcagcttggaagttctggagcaggtacaagcccaggtgggctctctgcttccagcctgagctctcaggctctgtgcctttttctgagagatacctgctcttagttaccctgtctgtaaaatggaaataatttcacttgcctgttggatgtattataaggtttaagcaagacaatgcatagaaaacacttaattcttagttgctggcacctagttctggcttgttcaatggtggccaacactcttataatggactctgcccctgcatgttcccagcaaggctactgaaccttctctgctttttctttggagcatggagttataatgcctgctccccataagaggtgctttggccagagtgaagtcagtggtggagagaggggcctcttcctccaggcacaagatctgtggctagcctggtggctagtctggccggctggcatcaggctttaaatagctcccccatcactcctcccagtcctgcttcccacacatggtaattaagctcacaacatctagtgtaagcaaataataacaagggcattatctccctttagtctgtgtttttccttgcctatcataaagtaattaaaataatgaatgccttgtaaaacaataggtaagagggctggcgaaatagcattatctgccacatacctcttgtgctatgaattactgatgcagttaaccactgtgactggagggcccccctgcctcccagcctttttcacgttgatttctcctctccagggtctaccaaggggctgtggaacttgggcccccaggactgaggagcagggagctatcttccaggtccccacgtggtggccagggaccagttcagaaacatcctgggaggcttgactcaaaaggaaacactagagcctcagatgtgggacgatctccctgccctcctcttttcctcacccctccaccaatgtccaatattgaaacaagcaggtggttctgtccttgggtgaagggagaggccaggagagagctgggggtgaagatccatgtctcatttcagcagtcaccgagccatactagggtagtcaggagctgtggtccccaaagtgggcttccaagcccagcagcatcagaagtgcctgacatcttggttcgaatgtaggttctgggatgggcccagcacactgtgtttcaacaagccctctggtgtgcttatgatgcccgctcattgtgataaccattgctttatggtgtcagtggcacgagaagaagcaaggggtgctgggataattgcttgaacctgtgttttgtgctattggacactgtttaatcctgacaatgcctgaggggctggcagtactgtccccatcttattgaggtcccatagcggtgggagagctggattttcccccgaatctacaccttcagttaccatggttgaccctgtatcagggcctccccatcctcctaaataccctcctgttcagagtctcacagggcagaggctcagggaccagggcaagacctaacaggtcctatctgaggctggcctgggaggcttgggcagcaggtcccacacatgtcagcaggcagcccccagatacatctgcccagtggcctccccctcctgggcctcctcttggatcattgtagctctgtggggcttaacacatttggaaagaaaatattagcgtccagggctgcaggtcccacttttctcttccccagcttccctgagccacaggcagccagagggagagaagcaggaatcgggaccagcttcctgcctgctgtggccaagtccccaagaggatgactcaccagtgcaccctccccacctgcctcccacgtgcctggcctccctctgccccgccccctttgtcactgcagacaaagcttttcaccactgtctttggttcttccccttactccaaatcacaatgatccccagtgtggctttgccttgggaattaattccagagttttaaatgatgaacataatttgctggcatctttttaaacatcttcatctgcagtcatagttgcagtgggtatttgtgttggggtccagttaaatgtacattgttagataaataatgaataaggttttagtataagcatgtcccatgtggtatttggaatatacttatactaaaaagttatttgttgtttatctgaaatttaaattttactgggtatcctgtattttatctggcaacactaaacccagcctttgtagctaatgaggggctgatactcatagccctttctagtcattcattcatggttattgagccaactctgtcccagacactctattaggcaccaaggctgcagcagtggggaaggcagacagtaagtgaaagaagtaaatgaattattaagtatattagcggttttaagtgctatggagaaaaataaagcagaaaagtgctattggaaagaaagtgttgcaaatttaaacaggtggccagggaagacttcattgaaaaggagatatttgagcaaagacttaagggagcaggccataagtctctgtgggagaagagtattccaggcagaacactcactgtatgcaaaggtttacagtttcggcccctatgtggggctcagttatctgatgaaatcagccttgtttcctcaagcacattttaagccagaaggggaatgtattgtctcctgtaactggaaaggtctggtgtagatttcaggcacagctggatccaggtgttcaaatgatgacatcagtagtctattacttttacttttctctgcagtggcttcattctcagggaaggatgacttttcctattctttcctgcaaatgttccacgcttgagtcttattggcttgtcatggatcatgtgattattaatggcccaattgctgttggcagggggtagaaaggactccaatgttggagccaatgtgaggccatctgtcccctttgaactacatagactgagaggaagagataattttcctaaaggaaagtgggggtgctgctgtgaaaaggggcatagaggctgggtaggcaaagaccacaggacatctcccacactttcctcctccctcctcagcatgccctaatcttagacagattgcgtttcctcttgctttggtattttctttttctttaaaatgggaggagaccagaactttgggaggctgaggtgggcggatcacttgaggtcaggagtttgagaccagcctggccaacatggtgaaaccctctctactaaaaatacaaaaattagccgagcatggtggccgcgcgcctgtaattctagctactagggaggctgaggcatgagaattgcttgcacctggtgggtggaggttgcagagagccgagattgcgccactgcactccagcctgggtgacagagtgagacttcatctcaaaaaataaaataaaataaaatagaatagaataataccatccttctttgtttcactaagatattttaagaggaaataaagaaaatattcttttttaaataaaggctttaaaaaaatcaaaggcataatttaccccttctgctttactcctatacctttaagctagtttccatctcagctggggaccccttctggctctggttctttatgggtagagcatgttatttaaatccattgttccctatgtcttaactcttgctctctctgttgccaggaggcccagaagattaacaatggctcaagccaggcggatggcactctcaaaccagtggatgaaaaagaggaggcagtggccgccgaggtcggctggatgacctccgtgaaggactgggcgggggtgatgatatccgcccagacactgactggcagagtcctggtgagtctccacccacttctcacaccaggaggccttgctgtctgggccaaggtggctttgcttatgagacgtgatattccccagggtcttctgcaggaggctggctattgggaggtgggggtgagcagcaagtgctcccgcgtggtcatggaggagaggctcggttccttgtgtacagtggtttgtggagggattttcaaggagtgggatttgcagtggagaagggttgttgggaagatgtagcacatttcctctgctaaagcacacatgcgcgcacacacacacaccctccatcatcttggagaggagaagagggttaaggaaatataccagaaactcatggaagggctacaaatgcggggatcctggggagtgctgagtgagtgtgtgtttggtggtcttcgggggatgttcttcttgtcctgtggtagcccatagggaccccctcttgcagcagtttcctaattttctgcagtgtgtgagctgggccctgtgcacggtagaaatcagtcatgctgatggtggatgcatcagtagcccacctgaggctgcctggcccgtgtacctagagctcgcttgtgtgcccttttctgatgagattgtctcctaagcccacctgcaaccagggctgattctgccccttctctgtatgtttccaacatctctctgatctgcttatatgaagcttggcttcactggctggcctcatgagcccttggtttttgtcaaggatcattactgggacaggcttatagtgatcaaccatcccagtttgcctgagactgaggggtacatgagacatgagtctttcagtgcaaaaactgggaaagtcctgggcaaacagggatgaattggtcgccatagccaggcccatgctctaggaaagccctagcttgctttcttgggtctgctctgggtcaggagtttccctgagaaggatattgcattcggagtgatttctcattgtgattctggaagctgttttgtttgggccacctgtcctggcatgaagctagggctcagtcaagagtcatttggctcatagatggaaggagtagggacatcctgaggcctgcgaggctcaaagaccaggcagggacactggaaaacagtcattatctctgagtctcacagcaaaaactcagtgaagaggtgactgtagatggagggaggtggtgagaatttcacttctcagaatccttcttggggagaactcaatgttatgtctgggatcaatatcacacacacttttgtgggaaggagtgagagaatgaacgcggtgcttgagtaatcaaaggtgctggccacacagccttcaagaaagacaggttctgttcaccgagggatctgccgtgagctgtgtgctgaagggtctggttatgaaaccatggctgatgtcaattgatggcaaaatggaaagaggggacatttaaagttggagttttggaggaggagagagaaactggtgaggtcagtggctgcttggaggaaggcagagagggagacaattcagtctggtgtgacccaggagggacagtgtctagtggggacttggaggtgacttgctgttggctgagctgtgtaacagcacctctatctctcctcctgcctcttgactgaagtctccattgctctttcatgcttgaagaggagtggattctgcattggaaacttaagagaggttgaattctgagtctgggtattcatggggacaaaatggaggtagtgtattctatatgtatggtggtgatagtgaatggggagcagcagacagtttagctgcacaaatgtgacacttgttccttccatgtggccattatagacagttctaattttcttcatcagcattgcaagagttactgaacactaattctgggccaagtgtatttgtttcagctctggagaaaacaaggaaggatcctgattctattgcaccatatgcggaagttattgaaggaatgcatggaggataagtgctatgagtacaaacacggtgtgcacttgtggagtgtggggaggggctgtaggggaaagtagggctgatcagaaaagctttcatagggaggaaagtctttgaactaaaactcccatttcaagatgagctgctttatggcgggaagatataaaaaataaaaacatatccaggcttaaacacaagaaaatgaccactaggtgggctggaatttgtgaagaatacttaataagacagaatgcatttgcagtgagcttttaagtgtgagttaggatcttgagagttaaaggagaagaaagccttcaaagtgaggagcaggaaaaacagagaaggagcctggcgctctgggaaatggggggtgcagaccccaaagtctggggaagtgtcctggagacagcctggtggggctttaaaggccatgctaaagaattttggggccaggcgtggtggcttacgcctgtaatcccagcactttgggaggctcaggtgggtggatcacgaggtccggagatcgagaccatcctggctaacacagtgaaaccccatctctactaaaaatacaaaaaattagccagtgtggtggcgggtgcctgtagtcccagctactcgagaggctgaggcaggataatggcacggacccaggaggcggaacttgcagtgagcggctctgctgagatcgccccactgcattccagcctgggtgacagagcaagactccgtctcaaaaaaaaaaaaatgaatttttgaagtttgtagaacaaggagattttgaggcagggggtgttgtacagagagagctgggggacaagtggagactgaatgggtgaggctagagcttggaggctataggacaagttagggcagtaagctactgctttagtgatggcatgggagcagattcctgatgtggtcctggtggggcacggtctgcactgacaccaagcagaagatgcaggtagcccatgtgggtgatatcatggaaatggaactcattgggcccagcacacccagcggccaccttgagactctcctggcaatcacactgttgaacgcctcttgtgatccaggcactgtgctaaccttatatgttatgatcagtttgaaggggaaggacaatgtcgtatttcttccatatctccttattgctgttgtgttgtaggggttcattacaagaaaacaggccaatcttatcagtgaattcatctctgttttacagttgagaaaatcaagatatagcaagggcaattatttgtctaaaaacattcagctttgagtgacagagccaggctagtacctgccagctccctgtctcccagtctggtgctccttttgtgtcattacttcccagtcgaagataatgccttttcttttctaagccactgccagctgtcactttggctgtgacattttgacattaccatcttttagccaatttggtcctgaggatgcttggcctgcttgttaaacatttgcatgtagaagcatggtccactcaggcctctttgcctgagcctgcccaaggtgccagctgctctctgaaggtctccttggagaaaatcctgcccaggctgttggggccatgcagagcaagtgggacctgctgcacagaaagcaggcatctcagagctccaggcggtatcctgagaataggcctgccctttaggagcaggcaggtccctgcactgaacaaagaagagatttcacaattaagtaatggcgggcaagagaaagcagcactgcctgttcagaacccaaagctgtgtttgtcttgagccgtccaaatgtttatccctgcaacaatgggaccaaagcaagaccagacagctggctattcagtttcccgtttcaatttttaatttgttttccttgatgcacgctcaggagcttggcctcctcatctgggcctctatctcacctgtctaattgtcacaggtgtgaatctcgaagctgggacatcatgagtaaggtccagctggggaagaatttgccaatacaacctcagaatatctgtaggatctcccagacgagcacatccgttattcactaagtgtttactgctcatctgtacctggcactgttcaaggcactgggcataaagcagtgagcaacagagatccaggtgtgaattatttatattgataaactagatataaggatgcagagctcaatttaagaaatgacaaatgataattgccattcaccagtgctttttatagtcaacgcctggagcctgattatccacatgataaaaattccttgaccccccggctccagatctcagaatagcctgtctttgcctcctctctcaccctggcactcaggctcaactggccaaaaacagcaggactggacagagccttctcttggagcacgtggctgagggattctacattaaagtgaacaccaggctgtcaagagtactgcttccttttatttttttcttaactaaacaaatgtttattttctgattataaaagtaatatatgtttgctttttttaaaaaaattgaaatgtgctggaagacgtgctgataaattccactgtgggatttggagtcggctcatgcggagggaaatttggatatagcagtcaatgtcgtcaggatttctcttaactgtttgggtgtcattgaggactttgttcactgcatctcatgttacctgctttatgcacagactcatgggataagtagtgttttgcaccagagattgttgtggttttcctggtgaacatccagtgagcatgctaaatcgagaaagggatcatgtctctcagtggtggctgctcagagccaagtcggtggcttatggaaaatacagagtggctcaggtttgcgctctgtgtctttgcacccctgctctggcttgtcttcatcatctctcctctcattttccctttgccctacttttcttactcctatttggaatttacatgtatgcagttatgtgttccatacatttttgtcaggtaaattaaatccccctaagaataaggtggtttctaaataaagagggcaagaaacgtatggtgtaggttttagtatagtttggttgtgctgtatagaatcataagccaaagtcaacagtggtagtcaaattcagggttggtaagtttttccataaaaggccagatagtaaatattctaggcttgcagaccatgtgggctccacgactcaactctgccacagtagtttgaaagcagccacaaacagccttggtgtgactttgttccagtaaactttctttatagaatgggagaaaatatttgcaaacaatgcattcaacaatggcctgatgtccagaattcatgaggaacttaaaaaactcaacaacaaaaatcaccaaataacatttaaaagtgggcaaaagatatgaatagtcatttttcaaaagaagacatacgaatggccaacaagcatatgaaaaaatactcaacatctctagtcttcagagacatgcaaattaaaaccacaattagatatcatctcacagcagccagaatggctattattaaaaagacaaaaaataacagatgttggtgaggatgtggagaaaaggatcacttatatggagatgtaaattagtacaacctctatgaaaaacagcacagaaatttctcaaagaagtgaaaacagaacttccatttgatccagcatttctactaattggtggctacccataggaaaagaaatcattatataagaaagatacctgaactcctatgtttatcacaacactactcacaatagcaaagctatggaatcaacccaagggtccatcagtggatgattaaataaagaaaaaaaaaatacacacacacacacacacatacacacatatatacacacacatgcatatatatcacattatatatgtatatatattacatttatatatatacaaacacacacaataagatactattcagccataaaaaagaatgaaatcatgtcttttgcagcaacatggatggaactagacaccattatcttaagtggaacaactcagaaacgaagtcaaataccacatgttctcatgaataagtgggagctaaatagtgtgtacacatggacagagagtggaatagtagtcaatggagactcagaatggtggaagggtgggaggtggcgatgagtgatgagaaattacttaatggttgcaatgcacgctatttggatgacggttacactaaaagcccagacttcaccactgtgcaaaatatccatgtgacaaaactgcactcatactccttacatttatacaaataaactgtatttatagaaatagggggtagagaaaacagttgactggaaggaataagttccagcatgtgatagtacaatagggagattatagttaacagtaatttattgtacatctcaaaatagctagaaaagaattagaatgttcccaacacaaagataaatgtttgaggtgatggttttctgttaccctgatctaatcattatacatgtaccaaaatatcacatgcatcccccaaaatatgtacactattatatgtcaatacaacgttttaaaaaaagaaacaggtggtgggccagatttgtttcacacaccatagtttgctgactcagtctaatttatccccttgttttatatataaagaaattgaaagtctggggctggaggcgaagagattctctaaggtcgagtagcaagagtgtcacactctttgtaaaggagcgttacagactcagtgatacacacacaaagataaatacaggcacacacacatactctcactatccacattgtcacttagtttctgcatgttcatattcatttccatgttgatctcacagcaactgtctccctagggaaactatgtcctgtggtgaaggacagcctcacctcaacttgggagcgacatctacactgcctagactttacctcaaccccctgacagattcaatgttttgtgtgtctcttcaaagactggtcttgccaaaatagctaccagctcctgagcaaagctagagagagcccttagaatcactctttgtagttactttccccatattcctatgctgttacatctgtgtattgctccaggaagcttacacagctaattctatgaactgaaagcatatgctacttgcttgaatgtatagggatgatttatcgatgtaagaagaaagaaaaatatcagcctctctctttatccccctaaatatgttgcatgtgtggcattttacattaacgttatatacatagcctggaccatttcatctttatctccaagggcccaaaagaaaatatgtgtcaaatatgcctttcaaataggaataatcctattggtttaacagagttaaatagatgtacattcactgatgtgctgtttgcgcatgaaattagactggttgaacccagtgggagtacacatgggcacacacataatcaaatatatcacattcattgcattcacttctgttaggtgccctatggaggttgtgacatttcccatcagtatcctctacttttctttctcagtggtgcctggtggcaaattcacacacacttctctctctctctgtctctgtctctgtctctcacccccctcatctatgccccagcttttattatattttaggcaaatctatgtaaaattcttacatcattggccaatgccttgtgtagcagaaagactagaggtttcacaggactgtacttttagtaagaatgtcccatagtgaataggtatgtcctgctctctgctattgggaatcagttggagttttattggcattgttttaacactcctaagggaggcttctgtttaaaggaaccatatgataatttccttccaggacttaatagtggttctgtatttcatcccatgcatagatactgaaatcacattatgggtatcagtcaaaaagtcaaagaagatacattctttttttactattaaacatgaaattttgtctttatctaatgaaagatacactagatttgcactagatttgttatttttgactcaacatcatttacccagatgagaaaacatgagtcagagaaataattgaattgagcagtctcccccgacaggtagtgagctgcctgttactagaaatattcaaagagcagcaggatcgcatttcatagtgctgttgctgacagttggttagactttatcctcatggctttaattaggttccatagaacactagacccacgaattgttcccggataaaaatggttccctgggaacttggatagacttcatttctcatccccctcctcgagattgccaatgcatatcagcatataaatacttacagaagtcctgcagtcagaaagcggaaaggctctgttttgcccagcattttccattttcatttccctgtggaatcctttccccatgtaatacctgtgggcatcacatagcactcactttgggaaacatttaattagcccagggatcagttagttatagcctgtgggacagtctggctcattgcctcttttgtgtggttcataagctaaggatggtttttacatttttttatttttttttcagagacaaggtttcactctattgctcaggctggagtgcattggtgcaatcatagctccctgcaacctcaaactcctgggttcaagcgatccttctgcctcagcctccctgatagctgggattacaggtgcaggccaccatgacatgctatgttttcttaaattttttgtactgatggggttctactgtgttgcccaggttggtcttgaacccctgggcccaggcaatcctctcaccttgacctcccaaagtgctgggattacagatgtgagccaccatacctggcctaaatggttattttttaaaaatcaaaataagtgtattttgtgacatgtgaaagctatatgaaattcaaatttcagcgtccataaacaaagttgcattggaatacagccatgctcactcatttacgtatcgtctgtggctgcttctgtaagaagctacaaaggcagagttgagtagtatccggagtccaaaacacccaccagcctaaaataattaccatctgtccctgtaaagaaacaattgccactccctgtatgcctgtcaatattcctcttcaagtggcctacaggacttgctccataagttacctatggcataggtaatagataagatataacatctgtccccttctcatggggacgtgtctacattcacttccccaagctcaactaagtactgcattagagatggagaggccagagccaggtgggtccccaagttccatagcagattcccagctggggtgaacatatggatttccacttcgcaaggtcaggagaatatgtctgagaattttgtagcagcatcattccttgagtttctccatccacctgcccactgcttcggcagcccccacaccccaggccctgctggcagctcagagtctaagccttacccccaagaggacccctgatcagggcctgcaggccaggcacctcagctcgcagcagcttctggtctgcaggcctcgagccatgtgctgggctctccggcacgccctgtaaagagcagctgttaattttactagctggtgtgttggctcctctgccctccccagggctgctgtgaaaatgaaggagagtttcagaaatcaaccctcagttggctccagagtgaggaagagcctcctggtccagggacagcccacttgatcctggccactcatctctggctcccaggccctcagggctctgatggcaagtgctggcatggctgttttccctctcctctgaagtttccaggtgcatgtgggtgcctgctttggccttccatcccattgtctgtctgcccatccatctatgtccattcatccacctgtgtgatccaccgacattgattggtgttccctagtatacagaactgagcgtagcacaggtcagtgggggcctggtaagcaagcagagcacttgcagcctctgtgcagtcagcagccagtccggcctgcttctgccggtcctgtcttgtctctgtccgctttgcttcagtctctgttggggcctgggagtgagaaaccctgcccctttgtcagtgcatcatgatctgaactagagctcctactcttttttgatctccatcttgctccttgtgtctcgttctcacttgattggaacaaacaaggaggatgggtggagcccatagcagcctcaaaactcacttcagctcttgcattgcctctctccctgggacacccatcttgggaaggagctgctgtgtgtggtgcggctgggcagttggaagcccagcctctgcagactcctgactcccagctccatctgtctcaggggcttggcttttaccctgggcgagtggcttcattgtctcatacctcagtttcctcatctacaaaatggggacaataatagtccctgcctcttaatgagttaatgcatgtaaaatatttagaacagtgcctctgacatggttagtgcttgataagcatggttattattatttttgttattgtgtgtgtgagcccggtcaccatgtcatggaggaaatgggctggtatggagacagacgggtcagggggtgaagaacaaatccttttctggggcaggggtagaagaacagcccttgagcctccccaaacccagacatcttccaagagtgctgagcagctctgggcagggccatctgaaaggctctgaatgccccaggcaagccctggtttggatccatccagatgatgatgtttgctctgtgcacacacttaattcaggcttgtccaggctgcgtcctctttgcagctggctcatgccagcctgactcaccattgtcaaattggccaggaaattctcacttcatatagcctccctgagctggctggggactggagaacgggctgggctctccctggagctgtacgttgtgggcgcatgtgtcacaggaaatgccttggcaggacaacagatgagtcttaaggaaaaagggtcaagtgcacttactgtggtctccgtatccacttctccctggaggtggggcgaggctgacagggcagggacaggctggtttcggagggcacatctgcaccagtatttggggaggtgggtttgatgtacattttgacaggtagtgaccacacattcattgaaaggagatgggaaagcgtgtgaggtcaccagaagataaagacccagattctactgcacatgcgaggcagctcctctgagctattcctccatcccttcatccattccttcaaacattctggagcacctgctcggggtcagatactgttcaatgtgctggacatatgttggttcattcagcaaaagctgcaaagtgcagtcatccaaagtgttgaaggtggaaatgttatgcttgcattttctagaatgatttggggtggcaaggtttctgaagtagggtttagtgataagtcagaacctgtgacccatctctcagtcccttggacaggcctgggagctcagacattctagtcctgattgcacatcctgtgcagttctgcagctgaatcccaggggcctgggcaaatatgtgagtagttggtttccctccctgcctccctcccttccctcccttgcctcccttaccttccttcccttccctcccttcctttccctcccttcccttccctctctccctcccttctttccctctctcccttccttccttcctccccactgccccctcccacctcccccactcctccctcctccctccctctcttcctccctccctcccttccttcctcgcctcattccattcctccgtccttccctccctccttcccaacccatgaaagctggcgccccctggaggcatttcaggaaatgaaatgtctgtatttgcggctactgagttgggctgggagacttttcttacccaggttttcccccaaggccttcagagggtgctgatggcttagcactccgtttttgtcagaaaaatatccttagagcctccatttcagctgcgagaaagtttgtttagcagggagactcaaaaatagagatgatgatgacaaagtcatcagcctttgtcgttgcaggggagtgcatgcttggaaagtcacactcgggaccacacgcaagctgatgcttccaagtttagtttacgaggctatgtttaggaggaggcagactgactcgtgcctacgggccccaaacagcccaatttggtgcactaaaagcctcatttttagactctgggtccagagtgaggctttttccagaaaaaaacaaacaaacaaacaaacaaacaaacaaacaaaaaacctacttcagggaaatgacaacaacagaaagccaccatttgccctaaaatttttattgtaaaaactattctctcctgtttgagtagtgagggatctaggacataacagtggcttctctggctttcttaaggaatcagggcacttggaaactcaattaaatgtacccaagcctcttaagcaccaaggctatctttttgctcatccagttaatttcagtttgtaaaattggccttgtgctgacatgatggagacggggtgagggtgggaagccagggtcctctgtgagcggaagcttgcttctctgttcacaagcctccaagggcacacatccttccctggggcatcaagggggaccattaaacctgtttgcaccacgtccctgggagagcaaacttctgggccttccttgtttactggaggttggttaattcggaaggtagatggactgggcatattggttccccactggcaggagcagcccaggattcagcaggttaacgcaaaggatcgagaaactatcaccttcctagaactgttcccagacttttagcaaacaggctgaattttgacctttttcccatttttctttttaatcctccctccccacatgttttgtggcttttggtgaaatggctgtcctaagggaaacaggacagttcattgaaaaggagagagaaagtaaagacccctttcccacaccaccttccctcagatgcagcctttgcttacactaaaaatagcttgaaacagaggctgaatcacaaaaaaaaaagtggcatttcaggggacagaggctgccagctccctggctgctgctgaagtctgttgggtttgttggtctctgagccccgacttgcccaggaaggcgtggggtttggaagtgtactgggataggtccagaacattctttttgtttctagagcaagggcctggttgtgtctgccttggttggagagtctgtccagagctaattatatcagcaggcactgatagagcctctgcctggtgttatgcctcaggggtggaaaatcacttcctgcaaaggaaaggagttgttttcaggagctccttaatccctgaggcacctgcatgggctcccagggaagctgccaggaggttattgtttcctctgaaccatgaggtgggcaacttggtttcttggccacctgagatctctccaggaaaaagctcagatcatcagaaagagagaaaacagtttactcaccttggtctatgctgtgtgtctctctggcccttggggattcatgacagtgtttgagatcaattctggatatgggagaagagaggcaagtcacttacttttatctgaggagctgcaatcagcagaaacctggatactaaccctggctttgctatcacttttctggttgaccttggacaagtcaattccctctccaaggcctcagcatctccataaatagagggggccgcagtagtttttcagtagttcgttcccttgcagcccaaaatatctttatgttttcttatccccttcactgtccttcatcagcaaaggccacaagtgttaggctcacatctactgtgcccttggccctgtgctaggcaccaggagaactgcaaaaggagagagaatgcacttttcttagctgccagagtgattggcgtgaagcagagttcatcaaggggtgtctctgcatggctctcccatggttttgcctccatttgaagtaaaatctgaaactgtgtccctggcttacaaggccccgtgagttacggtgcctgcttttgactcacctccaatgattcttttccttctttgctcctttctagagaagaagcaaagcctataggtagaagcatgtagatgggcctgaggcactgggcagggggaaggatgccgtgggaggagggggccatattccaaagggccagctcaatgagaaggagttggcttcttttgaatcatttcagccatggagctctcttttggaaccttcctcagttggaagcctctaaggggatgttgttcctagttggtatcaaacgtggtgaccccactagccccaaatttgactggaagagcctcctttccaattgagtatcctctgcttgaggagctcttgggtgagataacagcccctatcctttgctctttgtattgcttttgactgaactgctgcaaatcatggggcccctgaaagtccatccctcctccagaggtagaagcgcctccatctctgtgtacctgaaaacaataaaaggcatgtttatttaaaataatgactgccggaggcccccaggaggggctgaggatcgaggaaacattactgtggccaaagtcattttttatttctggagcaaggtagcagactcaggggggtggcaggagctgccaagctagcccccaaatttatagcaagggtgttaaacactgtgggtgatcagtggagttgacattgcagaaattccccaaatgaaaattccttgtaggttaacttttagatgaactttaaaaaacaggggcaacagaccctcaatgggctatttcaagtgtttccaatttcattaacatgatttaagcaaagactcccccttgcctccctggatgctaaattagaaaacatcactattcctctgcccttgtgcctagtttgcaaaccagtgggtttatctggttgttttccccagagttggagcactgcagctgtttccatagcactgcggcccacagggagttgtgtgttgggggctcagttgttgtcttacagaaaaaaaccttgtaaaggcaattcagcaagccacccttctagcaccaagagatacaattcctcttcccggggctgagatggagagatacagatagagagaaaagaaataaataaataaccagtttctctttcatttaactctcagaaacagcctctggtgctaattatttctgctgtagattttgtcagactttgaatcccaatccttttgccataggtggtatattttagagatgcaaaatgatataaaaaacaatccactttcctgaaagataattttgtgtacattaaacagacacattaagccatttacaagagagttgtttgttctcagggatttggaggaaatctgaatttctaattctgggctctttaataattttcaaaagaactgaggctaatgattaaacgtctttgaacttccccaggctgtcttctatcccatgatctcaaagcatttgaaaaggaatagaattctttaccttgatgaaatcagcaggagagtagaggagacaccagccccaccaggagctttgtggcagaatgggggaacgtaaagtaaagaggctcaagaaaagtgcacaaggtcactttcagagcttcagatgtggagttgaatgaagagccttcataccagttcttatttcacagccttggctgctaagacttggaaagaaggccaaagagaaaagaaaaccaaggtaggacttagttaaggatgtctataatgagattacacatgacatgcaatcttatctggctctagtgtttaaggattagaagagatcaagtctagcaatggtgaactttcatcatctttcatcagctttcatcttctgggttcattctgattgatcagtagcagctacagagaatatttggccaaagatttaaggttcagcagcaaacagtcataatggctctgctctaaagaattccgagggctgggtgcagtggctcacgtctgtaatcccagcactttgggaggccaaggcaggtggatcacttgaggtcaggagtttaagaccagcctggccaacatgctaaaaccctgtctcaactaaaaatgtaaaaattagctgagcatgctggcaggcacctgtagtctcagctacttgggaggctgaggcaggagaatcacttgaacctgggagtgagaggttgcagtgagccgagatcacgctactggactccaacctgggtgacagagcaagattccatctaaaaagaaaagaaaagaaaagaaaagaaagaaaagaaaagaaaagaaaagagaaaagaaaaaaaagaaaagaaaagaaaaagaaaagaaaagaaaagaaaagaaaagaacaattccatgactgactaatgatgcctgccatgagtgccagcttggagggtggtagtactagtgttatttgtgccttagctacctgttctaggtcacattccctaaagtttacattatgtgtgattaaagtggggcttgtccaaggtcatttggtcagtttcagacatgtctcctgaccctgtctagtatttgataccccagctgcataggttagacctcagagaaacagcaaatttgtcagcttcctgtagcagccttctttttcttttcttttttcatattgcagcctgacttcagatttttccatctggagactttctttagtgtttggagagcagagggggtggatttcagagccacagtgattctacagacaaacagaaatgcaagcacaattttcctgtttgttatgtccactctcaaaattctctttgcatgaagcacacgctgatcacagccctcccactgcaaagccttcccctcagcccactcccgggttctttctcccaatcgctgcagatgcctttccctgtgccccactcccccggcactgtaaaaagcttttggtgggggttgatgcgtcatcatttccttccatcatagcctcaccttctatttcttcctgtttctcccttaatgttctttctcttagctattcatgctcacatcttaatggctgtgcttacagagataaatacattttgcctctgaccaaaaacagtttctgccctgacttgaatttaaaagcctgccagaattgcagtggggagcagaggcagagtcctcagtttcatcctgggagccataaaagttttctaagagtttatcatctccatcaagatgaaaatgggatttcaaggcttcaaataggaaagataaataacaaggaaaactccagcttttgtcaaagcaaagttctctttaccagttttatgagtctacctgttgtgcctgcaccctggcatctgtttcactgtggtatcagacaaagccttctccaggaatttatgcaaacctacgactggatagagaatttcaggcaattggtagagcttggaagacggctgacaagtcatattcttgggccgtaactcactctcagactcctcattcgttcctcaattcttcctcttccccttccagcataatgggaattggaatagaaagccctattaactgtaaggcctaggctgtgatttataggacattataacaaacgggactatggttcgttgtacttggctatcttttgcatttgaggtggccaggattctttgtcaggattagattttgcccccttggcctcagtaaatggctgcatgcaactaggaaaggctcagccagtgtttccagctgctcaagatgaccccatgtttcctttgaggaaagcagtgctatagagcacccatgtgccactctggatggccacgaaagtgcccagtgagtgctccttggaacttgtttctgatgtgaaagttttggtgggaaactcggggagacatattacatcctggtaggaggcacgtcctatggatttgcccttgatgcttctttttccattgtcctggcttaagccctgtgaccccttccttcactcattatagcagctacatgtcactctcctcatttgtcccatctccccgcttcagtccatctttcatgctattgccagatgaattttccccaaagccagctttgcttaggtttccccatggctcagagaccttcagtggctttccaaggtctaaagcccaaacacttcaagcaaatggtcagggcccctatcctctttccaacctgtccttcttctgctctcctccatgcactccatgtgttcaaatcctacctcatctttaagatgcagtgcatagtgtttcctcctctgaatccatcagtcttggagagtattcgcatacacttgtgaatgtgacttatccactctaaaggcaatgaggctgagtggttaagagcacaggctatagagccagactggctgagtttgacctttgttctgccatgtactagtgtgaccctgagccagtgacagaagacaatcgtagtacttacctcatagggttattatgcagattacatgacctaatatttataaagtacttagtacagtagctggggcagactaagtgttgtatacattgttaataaaacatagtaaactgtaagttcactgagagtcagaaacatgtggtttaattttataatcctctttgtcctgtgctgggctgaaacaaccttgaaccagattgctgtgaaaatgaaatttgaagagagagagagagaagaaatatatgtgaaagcacattgtcatatttttattcaataatcaataattcaataatcttattgagtatctggagagaccaggctctctgttgggtaattgttgatcaaaatggaatgagatataaatcatgtataaacacattgagtatgactgtgtagaagacaagtggcaaacattattcttctcttgtccccatgttacaggtgagaaaaccaaggctcagagaatctttaatagcttaggtgagatcacacatccaataagcatctgaactgagatttaaatctgggatctcatgactcgatgacccaggctgttttcatgttaccatggtgcttctcattcaagaatgagtgaaggaatgaatgggcataggaaagaatgaatgaatgggaagatctcaaacatacgtggctccagaaagagagcaaaccagaggcttgccatagaaagtgagttgtaagtcagcttgggcaggtagcaaatccctgaagccataaccatttgtccagtcgagcattcactatggtggtgagatggggcagtttcattgcctcccctttggggaccaccttgctacccctagtgtcatacctcagtgctctccagttatttccctctgtggcaagagtggctttattttcttctcttttgggtattacccaggacaaacagtggatgtgacgatggatggtaaaggtacgtcatcattccctctttgatgtgctttcatcataatgggcctatttggaaggtttccataagtacaggaacaatgcctctccactgggcttcgtcagccaccaatgatccgagcaccagggaaaaagtctggagtgatgctggctggtttccatggcaaccacggcttgcctcaaccctgcacacatgctgccctctttccaagtaggaatgtgtttatttattattggtccaacctgggagtgcctgtgcagctgcataggtgttgtccctacctctgccattgaggtcatgttctcaactgggagatgaaatcacagctgggtgatggaggcacggtatttgctccaccaggaaaagctctcatttaggcttcagatcttgtattgtccatcagcgtgatgccagtgatctccgcgggggttagagaggctgatctagaaccattagagtcagacaccatctagggtcctgcggtgaatcgcaaactgccccagagagctgatggtgacgcacaaatctttcataaacatacagcatgctgctgtcccttggggatgcccatgagctggctgagcacgcacaagcctgagaaactttaaacctgggcagtccaacaccggtggtcagtgagcatctgaaatatgaattgctgtgtgctgtaaagctgggagtagtagtgcacacctgtagtcccaactactttggaggtgaggcaggagaatcgcttgaggccaggagttcaaggactgtgcagtgagctatgatcatgccagtgcactccagagagaccctgtctctaaaaaagcaacaatgctgtaagtggaaatttagtacaaaaaaagactgtaaaaaaaccttattataatgtttatattgattacttattgataatattttgtatagattaaactccattattaaaattaatttcacttttttctttttacttttaaaaaatatgctttctagatggataatggtgatggctgagcgaccatgtgaatgtacttaataccactgagctgtatacttaaaaattacttaaatggtaaattttatcttatgtatattttatcatactaaaaagaaagcaaaaaaaaaaaaaatctcgaggttaagcaaccatctctccaggcctcttcttcagcagtctggcccacatttctagaagcccccagcacacctgcacatttatttcacaggtcaagaaccagtcacaggtcggtcctaagccaattgttggcataagaatgagagcaccagggcttgctcagactaatcgaggtctgcccaggagtggggccagcatcagttttggtgaggtacctgcacccctgaacaaaatcagggttctctgaatgagggagggggatggaaatgactgttaggaggcaatcaacattataatcttaaagaaaaatgtacaagaaaattaatgtatgggagttacaagtgagagcaatctgaaaacttctttcctccacttggaatatatatatatatatattttttttttttttttttttttgagacggagctttgctcttgtctcccaggctggaatgcaatggtgtgatctcggcttactgcaacctccaccttctgggttcaagtgattctcctgcctcaggctcctgagtagctgggattacaggcacccaccaccacaccgagctaatttttgtatttttagtagagacagggttttaccatgttggccaagctgttctcaaactcctgacctcaggtgatccacccgccttggcctcccaaagtgctgggattacaggtatgagccaccatgcccggccccacttggaatattatttgtctttaaatttgcatagagttgtaaataaaataagtgtcaaagaaatgtgccttctagaaaatttagaatgacctgtgtggtttgtcttatgtttcttctggacagcgatgctgataggggctcttctcctccaattacaaactgtcatcttggacaagctgcttcactgtgtctcacttgcttcatctgtaaaatgggaataatgataacacctgtttcatagacttgttagttaatacatgtaaagtgcttagaatgtgtctagcacatagcaggagttgaacaaggatcacctctcattaggggctgcagggggactggtggctgctgctgaagccttcagaacctcccttcacatgctcaccacagctcctccagcaggcagaaggcttactcggtggtgcagagaaattaccccaaaggaagcttttcatcagaggtggctgatgagtgcctgatggatgccttttcctccctagatggtcccaagatgactcttcctagatgaagggcctcctcctgagccttgttgtagctcagtggaaaataaataaagagggaacaaaaagtccacgaagaagaaacagtttgttgggtggcgcctctcagggccagtatgatttaattgacgtcaagcctgttatgagtactcatgtggctaggataagtggcattggaagccgggttgcccagcatccttgctctcagagccccacttgatgaccttcttaggggttagtgcctatcaggaggctgttttgagagtatctgtggggaagaagggctcagatttaaaactgattctaagtcaacaattcaaaaatataaacaagggaatttgtggttgctctcacaattaatttggaccagcagcccactggagacattgctgggaaccccaaggaatgtagggatttaaaaaaaaagtcattgaaacttagaccacaatcactgggtcccaacaggctctagtgttaattcaaattgctatctattgggtagagaaagagaatttcagtgccagaagctaccatagagataccttgtagttccaccttatactgccgagaaggaaaccgaggcctggagggagcccatgatgtgttcatgtttacaccgcaagttagtgttaaatattccattttttggaaggaattttacttacatgcatattttccattatgtttataaatttccccctattttaaattatccccattccctactaattgtatctttcattttttctttataaaccttataattctctaatatactatatatactttatttattttacttatcatctatcttcccctgtctccactaaaatccaaactaactccataaaagcagggctttttgtctgggtcactcctgtatggttgacacttatttcctggaacacagtaggggctgaatgaatgaatctgttgaacgaatggatgagagcctgaatgggtctcatagacccatcttggtagaagtaagttctcctttggtcatctaattcagagaaccttggggagaaatagaaaagccatttccactccaaatgggaatctaaggtcagaaaagcacagggttgcccagggctaagctgtaaatattggcattctgagaaagaggtcataagtttggagactttgcactttctctttggaaatggaaaagtcatttcatttcaccacatccactaaggtgcatgaagtaaacagcagacacgctggatgcttggggcatcattccttcaacagggacaacagctttcatgagggttctactaggttaagtagagaggagcagatttttcaggggaagggatggcagaagcaaggctgagaagtcaggcgtgatcattcatctgagctcctactatgtgctgggctcagaaccagatgtggatctacagcttatttatgggtgcatttgagggagtaagcgtttatgagtaggacaatgagggagagaaggattaacattttctgcccgtttcctgaaatgtgtcttaattccttcctaaggaaggctgaccaagaaaataatgcaagaagagaaagtctcttcaaaggagcccagctaggggctgtagatgaaaggattcctttgtgaataaaatgaaggaaggaaactgaagtggttcagtggttgaaccactggctgaatgaagacctgaaataagggaaatgcttctcaaaattagagaccaggctgggcttcctaaagacgactcatgcggagggaggccccttgagctggagggctcagtggaaacctagagacagaaatgagatgtagcagtcaagcagaaattgaagaatgttctttatattgatacccaccatgtgaagagggtgacagtgagtgtgatgcctttagatgcacatgaaagaactttcagacgacaacataaaatttccaaaatattttgtttaacctgttcacacactttcattcatttttccccctctgagagtaactatttgtaaccccaactaataatgaacactagtgtttatgaaggatttactaaatgccacctacaataccaggtgatttttctacatcacctcattaatcctcatatccctactatgagagtaggtaccgcattcatccccattcagtggagcccataggggaggaaactgacgtgggaggctggctcagttcccttagtgatggcagtctgatggaggtgctgacccaagtggacaccaaatgttttgtattgaaaaataatacagtgcagcattatggggcagggatggggagctgctggcccatgagctggatatagtcttgatgtgattttatgtcattaaggaaacaattactaagagtaacacaccctttactcctgtagtcataaatctgtagtctacttttaaaatctactgataagcttccaaaattatgggttcctttaagaaagtttctctttagttctaattttattattgttgtttgtttgattgttttcttttctgcctacatatgtctgattttctcttcacaactgcatcctagatgccttccttagtctcttctgcttctcttctgttactcttgttttctgcttctatatatttatctgctgttttcctttctgtacttttccctcttctgtctgtacccattagtatcccttaaatgcctgtgaaaaggaattcaagtgagttcttattgcttattgggtagaagagggttttatgctttaatttaaaaatggttgaggatttaatagtatttctgtctttaaaagataataacattacattgcttttttactttatttgtattagaaaaatattctgactctccattaggcagttgtccttgatagagtgggaaaaaggctcagaattccgtcaagcaggtgtatcaagaagttgctatttggtctgttgtctttcctggttattcattattcagtttaacacagaaatcattaaacatacactgttttctatggtgccaaacatcaaatgaaacatgcttaggcctgtgaaccaagaacttctagaaaccagacaattaccaagggcgtcaaaatgtctcatcttgttgcttgtaactgaacagtgaaaatgagcgtacatgtaggggccatggaatgaggattttaatttgaatcagaggatggggtgaagagcagtcatttacaatattacacaagtcatcttacaatgaataataattctatcttgaaattccacccttcctgccatgtgattataaatttgtttataattgggtaagtcccaccagtcctgtgagattgcaccatgctttatgtttgcatacagtgctttatgcttgtcaaggtgctctgccttctgctgtcttatttggcatctaaacatcctaaataccctgaaagtaatgagacctggagctaagagctctctttacaatgaggaagctgaggatcagagagcttatgtcatttgccttgactacagcaagttgctagtggctgtagacccaatgcaaaccccacccaaaccagagccccacccaaaccagggcttttctcttgaatgcatatggcaagagagagacatcccactgtccattgtgttgaaggtagaaaatgcagaatgtggcagagtgagctaacccgcttggtggccctcaccctggcaagagacagattttccttcctctccctgaagggttaagacaaagaaaatatctgaaacttttcctagctgagcctttgctccagaactcagacacttttgcgacggaagtggggcattggggaggcagaaaaagccaatacataaaaaagcagcaacctcaccacctcacctgggtccccatgaaaccattccacccagatgagtgagtcagtgggtgttcttttcatggcctgtcggctcggtggcacctgaggctgcagtgacccccagtgctgcttcaggtgaatgagcacacagagcattttcagaactatggcttactctctcagtgtatagcagtttaagtgctagggacttctctgaactcattgaaagaaataaagcccctctgtctttgtatccctagaattggaagctcatgtatttgtgatgctggaaagggcaaatattcattgaaagaaaatagctcacatttactgaggtctcactatgagccaggcacggagtgaagcaactggttggcctcaccttgaactctcacacccagactaggagctaggcactgtgataactgctgttttacacaggagggaactcgggctcagagtggatgaatgacttgctgagggttgcacagctattaagtggtctgcctccatagcctctacttcccaggatctccagcaagggatatctcctgaggcagtggctttcacactcttagaggcctggagctctgtgtacactaactgaaacctagctgctttggttagaggattggggtcaggaggagactgtatcctcatggcccagcaagagttccgcaaaacccttgggattctcagtagagcagatcaggatgctaatgccagccttctctggaagtctgtctctttgaagttgaggtcatttccaccacaccccagagggacccatctagtcgacgcctgcctgcctggccaccacttccctactggaaaatcatcatttcccatgttctagttggggaaggacccagcagctctttctctttggcccatctctcttccttttatgagccagctaaaaggaatcccccagaggtcatctttgtccttggcgtgggaaagagagaggccttgtcagcaggtgggggaggtaggaaatgctgttctcctgtgggctgaaggtcagtgaaaggtgagctggggctcctgaggccagcaggttctggcacagaagcagcccgggaggaagctgccctggaatgtgctgtggacagacctgcgtagatcccttctttcccacgtccaggctgtcccagcatctctgaccaggccaaggtcacctaggcgcaggctcttctccttacctcacagacaaaaagaacttagcactgtaatctaagtgttcccactcctcatttgaaaaagggaagcatttcatttttatgtatgtatgtatgtatgtatgtatgtatgtatgtatgtatgtatgtatttatttattttgagagggaatcttgctctgtcacccaggctggagtgcagtggcacgatctcggctcactacaacctctgcctcttgggttcaagtgattctcccacctcagcctcctgagtagctgggattacaggcatgcgccacgactcctggctaatttttgtatttttagtagagatggggtttcaccatgttgaccaagctggtcttgaatacctgacctcaggtgatccacccaccttggcctcccaaagtgctgggattacaggcatgagccactgtgcccggcctcattttttttttttaatgaattaaaaaaaaaaaaacttatgtggcagttgataaaataattattttgaaattagccacttatcttctagaaaaaaaaatgtttgttgctcttctgatattggtaggagtttcttcctcttccaaggtgactttttggataacaccctgaggggactacccttcatcctttatctccatcgcagccattccaggccttctgtgactcctgggataaaataaacattagtgggcactgttccattacagggttcccttttggtgtgttccattgttatctccccctctcccccaggacctattctcccgggaaatgataaacctgggggctttagtggtggagaaggtctacagagcccaacctcaacttaaaatttccccagcctcttttggaagccaactaggtacctgattttcctgagtgggacacggcagccccctgggtggtcatagcaccacagtatactgttttacttacctgtatctcttggccatgccagcagcaagagcctcttggacctagaatgaccaaggaccgtggcctgtctgagttttaactctggatttagaagattggggatcttgtttcagacatttactcatcaacaaataccaagttcattgcaggtagggttcttggaaggtaagctctgacacgaagttgagtgtgctggaggctcatacccacgggaggaggggaaggcagcaggactgtgcagaggttgagtcgtgatgcaggctggatgcagccacagccagccccaagagcaccaagatggcctgccagcattgtgctggaatgagtgctgggatgggctgacatgggcctttattccatcactcccatcactcagaggaggtgggctgcccctgaagggcatgacctctggccaggtagctctctgcaactgagcaagccctgaagaagctgctgacaaccctctcacgagctgagcagcaagtccttcttgaagggggtctgtgcctgtcacaggattttctcaatggctgaggcactgtgttgaaacatggcagatcaagttggaaaggcttggtctctgtccatgaagtgcttgcagtgctgttgccctgactgcagtgcggtggatgctattatggaggactcttgtggtggctgcttggtagccccaggcaggcaccaggtcattaacagccgcgtgaattcccttgtcactcctaggagatatatacctgcacctctgttttgctgaagaagaaagtgaggttctgaagtgttgagtagctcctaggggtaatacggccagctgggaaagatgccaggattcaaacttaggtcggactctgaaggcagtgtgctttcctttattcataattgcctttgagattgaaggcagagccaacaggagcaggaccattgtgggtgttcagcagtgtcccctctcctacccttgctcatacccagttttagctctgtgcctggactctagctgtcccccgccaatggtgccacagctccatgccttttctgtgaccttcaccactttctctgcccttggggcttcctcttcctcttgacttttctcagcacttaggtgttggccataactgtttttggatgactgcattgggtaagtcccaccagtcctgtgagattgcaccttcccaaaaggcaaggaagttgtatggaaactggtttaggccttgtgtgagattcctttgctaacagtccaggaagctgtgtctggggcagcttccttcccccaaatatagatacttctccaagcttcctgtctggaatcagggtgttgtgaaatgtgggcactcattcagtcctaggggtcatggggaaccctaccagctttcccattaaacccagctggtaaaatggactcatgtctgtttgtttttggggtttgtattccctcctacctaaagaaactgcaagagaagggatagaaaagaccaaggcatcagcaagtctgtgcccaggagtgcaataatccttgtgtttactggaaggggaggctggcattgaacccatgtcaagataggtttggagaaaacccaaagatgccaaggccttgccttccatcccctgtgatctactacttaatcaaatagccaaggatgtgttaagagggagaaatgtgtaaatgtttagagagcagtgagttgtgagctgtaaatggccctggcatgtttataagaaatgagcaggccagaaatgaaaccccaatagtttttttgtgtggatagaattaccaaactgatggatggagggagtgttctggttgttaaatatttgggccttgggagtcttttgatgtagcaccttgtgacaactgcttgcaaagtgagctcagactagcttaaattagctcaggcccacatgttcgggaagggaggctggagtagattcccgccatggttgtttgcagctctcccttctaagagttcaggactctggtagtcagagcgcccaggcttggccagatcagggcacctggggaagggtttgtctctgcctcttactaccacatgaagtactcagagtctgggtgattgtggacagggcttcagatcaaggaaacttaagattctcaatcagccattgacatatgccaagaccaatcaatctttttcatctcatctcccattatccacccttcccacagccataaccacccactggtcactgtgcatgtctccctcctttgtcttctggtgtccctgccatggttccttcaggcaaagatgcttcttcaacctatccctaaataattctgcttgaaccttcagggtcaagctgaaagtggtacctttttcacagtcttcctgggcccaccaactggaagcaatcactgcctctactaaagtccacatcaattaaatagtcaattagatagatccagagtgaaaatggaaaccaccttctttttgcatcagtgggatggatgactggaaacatggatgaccagacaggtgaaaagaagaatggaaggaaacatgagtggaaggacaaacatagtgtctcctcgttaaaaaaaatactgtttcagctttcctaacctcacctgtaatagagctaggaacaatagccccatctcattatgtgagaattaaaatacttagccccaggtatgaagcactgtcccattattgttgttattttggaaaataactccgtaagatgttcaaccctatgaggaaattattctttttaagattcaggcttaaaatcaaatattcctggggcttgtaatttcccatgcagacctacgccctcatgttactgttgaagaaactgagtccagaagaggggagggagggacttgctcacactcccagagttggtggcacctgggtggcaaagtataattttcaaaaagttaaaattgtgactcatacaaatctagaatgtggacatgtcaaaaatgcatttagctcattaatgaggaaaccaacaagatggcagcatgagtttacataggcactggaggaagagtgttggaatgagattgctaaattagaaacaaaactggttaatgtcctacacgggagtcaattaataaactttgagattatcttttctcctgaacagaaaacatttgtatttctactaggcaaaatcctacacattaatgtgtaacttcacataatctggctatttagttggtagcaaatatcaagtcaacaaaggtacttactttcctctaggtaattaaatatttcttgggcaggctgttaaacattgctccacagatgaccttgaaaggacatgacacatttccattccattgcttgacccctgctaatagaaccaagtcttctcacccaagctgctcctctcttcctcttccatctctctgctgcatgcagggagcctggtgccttgcttccattttctcattggaaaaatgagggccataatacttgccttctccaccagactaattatgtccagttatgacttggggaaccaggcaagcgcatggaagaagatcacacaatcctggatccggaagaccttggcatccaagggaaaaacaggtgtgggcaaacaattgcaccaacatttggcaatggctgtggcaggcaagagcaaaggactgcggcgcctagagagaggagtgacttggctgagtaaaggaagagaaaaagattgagagaggaacactgaactgggatttccaagacccgtagatctgttggtgaaaagggagaagggcatggtcagcctggtgaactgcagatgttaagatatagggactaaaaagtaaggcactttccatttaatgtgcatatgctgagcttttgttatgtggcaggttctgtgtttagccctggggagtggcagcgatgggaacaatcgtgggcaaaacaggaaacaaattctagtccttttggagtgattccaggaggatgggggtttgggtggatttgagaggggaacaagggaagtggagtggaggcaaaagaggctggagagactggtcttgcactgagtgatgatatggttgatagctcctgaccaaacaattaatctttgttcagaactttccctttggaaagtctgtggctgccttctggggaaggcaaacaaatgtgaactcaagaagtttacaatttagctagggaaacaggatgtgcaaacaggaagaaccaactatgtgaaggtaggtaagataactgttgactccatgctttaaggaaaggagagctctttgtggcttgggtggtcagcaagaattttttaagcagagatactcttgattgggttggataaataaaagagcaaggaggacattgtaggaggggaattgctcccagcagagcctagaagcagagagattttccagggttcccaggagaagagattgaataagtgcagtgggccatgtggtgacacatcttgagtgtccagctggagaactggaagtgcatatcataacaggggtggaaaactcagaggttgatagggaatggtgaggttgcaatgaggggaccggtggggactttgaccagtggagcaagagtctttccagatgaagggagcagctgcctcacagctctggccagctgtggacatttggccagtttgtaatttgtcaaaagaagtcagaaatctgcattgttgtgaaatctccagattttttacatgttgtcaatttaattaaaatattaaaatcagcccaggggtcaagactgctgacccatgcatggggcctggggggaaacttgtggggctccagcttgtggcttctctgttggcggtgcagctgttgaagattcctacacacaggtgccacaggggaagatggcacaggaaaggagtgtggacctggagaatcaagtaaggagcaggcagcaactgaggcagggccatatgcaactgtggccaggggtcacatatcatactgagcagagttcaccttgcccgagaaccacaaacccaggacaaatagaagggaaacaaaataaaggaaagggagccagcgtgtctcgttcagtgttgggtaagtagtatgaatttggtttgttttcctggctgtctttaaagaacgctgggcggtgctagcctgtatttctgatgagaggaaggggatttaacctgtggttcaagtgcacttatttggatagctcagagtcttcatatggtgttgttgtgcaaagagcactggactagaagttgggagacctggattacaggaatgactggtgttagctgagtgccccactgtgtatcaggtattttgtgcacattttcagtaattctccaaacaaccctgtgaagtagagggcactgtgactctactttttcaaggtcaaggtcacagagttggtcaatgcaaggctgggattggaatgagacttcaaaggccaagtcttttccagtagaccccgctactgcactggcctatgctgagtctctccacatgctccatgttacctgttgtgtgaacttggataggtcatctaccacagaggagcaagaggggaaacttcttcagggtttgcttggtccagtctcaacatgctgtggttctgcagttgagatgcatgttgaaatgcatttcatttgtatgttgactttttttattctaaaggtctttggatgtttaatttcaaacaaagagctagagattggagaggcatcaatctcaaacaggcagcggcaggggtgtttagaatgaacttgacagccctgcaagaaaagatgtgttcttatcatatgtggaagggctttttttttggtaggaaataggtacttggacatgtaaaaatcaggcattccagcatggctgtccccaaggcccccacctggaggcttagactgcagcttctgctgttttcatatctttctccccttttatcctctctgaatgtttccaaacccccaaaggacctgcaactttaaagagaaatattattgatgcagttgaatctatttttagcctgctggggttggtgcacatccaaagcagaagaatttggttttatatctattttatctacatcaacacttctttacctaaaatccattaaaagataacagaaacagagctgacttcagacgacattcaattggttcatattttggggggcaatatgtcatgccccaccttgctgtagctgagacatgcctttaacatttccaaggagccacagaaaaagacatagaaaaccttcgattgcatttagagattagaagaggatttttctcctaaatatggagctgtttccttgactcagcaggtatgtgagatggatatgaaagcaaaagatgttcccttgccatgaagcaagtatttttgagtcatagatcttattgatcagactcattcaattggacatttctcttgtgtgcacacatgttccctctctcctctgtctcctcctgcctcagtaacttgcagagagacttccaaaaagagagcaggtttttagagttgagagttaaaacttctggaatgttgttctagctcctggggttgggcagggaaaggtaatcctcaaatataggtggggcctcagaggaagtttggtgaatctgtcaactagaattttttcttgaaaattctcattgaagtaacctctatcctcaaaggattccaatatacatctagggttgaaaaggaatgaactgatggccttaatcagattgatttaatgagcatagggccagagccacaagagcccagactgggtttagagtagaggttcacacatggctgccagttagaatcacctacaagacatagaaaaaattccagcacctaggtcccccttcagagattcttattcagttggtctgagtgaggtctaggcttccatattttgtaaatcctcccagatgacttcactgtcatttccactctagagctgtgcttcccagactctaatgtacagggaaattacctgggattcttgttaagatgcagattctgaggacctagagaaatggcaagacataccatgttcatggactggaagactcatcctagtaatggtgccagctcacccccagatttctctacagatttaatgtaactccaaccaaaatctaagcaggactgtttgcagatataaacaaaccaatttctaaaatttatgtgaaaaggcaaagcaactagaataggtaaaataattttgaaaaagaagtgtatatttgaagaaatcaccaatcgccctacctgattttaacacttgctataaagctatagtaatcaagacagtgtcatattggcaaagggatagacacatagatcaatggagtagactagagtccaaaaatagacctacaacaaatatggtcaattgctttgatagaggtacaaagacaattcaatggagaaggagtcttttctacaatggtcttggaacaattggacatccaagggcaaatgaaacaaaacaaaacaaaaagctcaacctaaacttcatgtcttatacaaaaattgactcaaagtggatcacagatataagtgtaaaactataaagctttgataaaaacacataggagaaaatctttctgatctgaacttaggtaagttagacatgaccccaaaaagatgattcacaaaagaaaaatggatcacttagacacgtcaaaattagaaactattattctgtgaaagatactattatgagaatgaaaagataagctacataatgggagagaatacttaaaaatcacatatattacagaaggctttatagccaggatatataaagaactctcaaaattcaacaggaagagaacaagctacccaactggaaaatgggcaaaagacttgaatagacacatgatcaaagaggatatttggatggcaaataagctcagaaaaagaacatcagcatctttagccattagggaaatgcaagtgtaagcaatgatgagatgtgaacacacctattataatggctgaaataaaaataccaacaataccaagtagtgatgaggatggggggcaactggaactctcagacattactaatgggaatgcaaaacaatgttgctattcaggaaaacagtttagaagttttcttataaaattaagcatatacttagcatattaccagaaattcaatgtctagatatttaccctagggaaatgaaaacttaagtttacagaaaaaacattcatatacatgtttgtagcatctctattcataattacccaaaactaggaagaatctcagtgggtgaatggctaaaacaactgtgatacatccttaccatgaatacatgcagtagcaaaaaagaatgaactattgataaaagcaacaacttggatgaatctcaacaacattttgctcaattaaaaaagccagcgttaataggttacatattatatcaatttcatttatgttacttccttggataggtaaaactgtagtgacagaggacagattagtggttattagtgggtaggggtgataggtgtgatcataaaggataatgcaagatagtttttggggcagagttgttctgtatcttgattatggtggtggctatacaaattgacacatatactaacattcgtagaactttacaccaaaaataaaaaattaaatttactgtatagtaatttagaaaatgaaacttttgaaaagtgcagattcttattcaagaggtctagcaatggggcctgggactctgcatttcttataagctcctgagtgatgctggggctcttgggaacacaagtggagggggttaggctctacagaggaaacatcgtaacatgcagattcagctcatttcattcctacgctgagagacctttaacggatccatagttcttccaagataaaattcaaatattttatcacttcaaaaaacttaaagtaagctctttcccctgaaatctcccatatccctcagatcataccctacagcagtgtatattctctgctttgtttgtggcctagagtgctctctatccacccattccctggaggatgagtgaccccttagtcactggccagcttgaaaggcaccttcccagggaagccatccccgaccctgccagtccctgacacacccgtgcggaatgagggtgcaccttctaatgcagtatgcatgctattttgctctcatgttctttcacttttcagatgtttctctccctaggaacacaggcttttcaaagacaagatctatgtcttgtaggcccggtgaccagcatcatggcaaatagtgagggttgctgaggagcttacagaatgaagacaaactgactttatagaaatagtgaatgtttcagaagcaggaaagtatcctcttaggaactatggggaaaataatgaaggacattcattgatttccaagaacagaagatgccagggaaggaaaacagcttcctccacaatctgtgctgcccactccatgcaggagatagggttcatccacatttgtaaagaacatgtgtgtgtagagtggacttgtaatgtaagcatcacttccatcaccaccaccatcatatctccccagtatcaccatcatcttcaccattaccactatggaacatcagcaacattgctgtcatcatcactgtcatcaccaacaccaccctcataccatcatcatctcaatctcttaatgttattgcaatttgtgtggtgtaacaaaaataataatgactccaaaaatgaaataataaaaatgttaaaaagcacatgtggccgggcgtggtggctcatgcctgtaatcccagcactttgggaggctgaggtgggcggatcacctaaggtcaggagtttgagaccagcctggtcaacaaggtgaaaccctgtctctaataaaaatacaaaaattagctgggcatggtggcaggcacctgtaatctcaactactccaggggctgagacaggagaattacttgaacctgggaggcggaggtggcagtgagctgagatcgtgccattgcactccagcatgggtgacaagacagaaacgtgatctcaaaaatagaaagaaaggaaggaagaaagaaagaaagagagaaagagagagagagagaagaaaagaaaaagaaagaaaaagaaagaaagaaagaacatgcatagtacctgagaatttgcaaagtgcttccttggaattaactccagctgcataaggaggatgcactgaattattcacctcactgcagtctgagttttattcttttctccaagcccttatatattattgtctttggatttcctacatttgtgtggggatctaggctggaattcttctgcccatcttgcaggtagtataactgagaccctgggaggttaagattatagaacttgttagtgaaggatcaaggaggaagatggtttctaagtagggcccaccaaagtgccagagatctccatgagaggtgtgatgagtggcctgaaccatcacagagcacaaagcacaggaaatcggttctcagaactcatttgggaagtcagcggcaagttcacacaccaaggtgaaagcggcactataaaaggatggatggaggtacagtaaagaggaagaggaagaaaagaggaaacaaaacgtggccataaagtgtagcttctgatacatagtgaagggacagaaggtgaatccttgtaaagtggctagcctgtcgggagccacactatcacctgctccaagttacccctcctctgcccccaaccaaagaagattgtgcatgagagttctaccattgattgagagactctctaggatcataacatctggaattcagtcctgctttagccatcgtctatggtagtaagtgatcttgaagaagtcaactaaagcctcctcttcagaaggtccccagacaaagtatctaggttgctgaaggcttgggagtggaggatgcacatgaattgccattgcctgtcttgggttgggttgtggtacttttgaaggagacagtgacaaggtggctttgtttcctagggtggggtgctagagagtgagattgtgatgcttgtcatttggtccaattgctactgctttcagttgagcactggtgaggaaccttagttgattcttctatgtaaatggctcttgcacctcaattttcttggcaattactccccagctgtgcccttcttgctgcataaaacctcaatcaatccttcattaaaatgctacagaaactgaaagcttttcccccttgtttcctaatttttccccgagtggattggatttgttatgactcaaatggaaaaggactagctttgtaagcaggttcagattctagcccggttcctatttatttatagcccaaattatttcaacaactgctgtccagtaaaaactctgtttaatcagaggcaggtaaacgtgccaatttcatctcattgcctaagtagtctcctctgctgtggaggaggaggatgccactctgggtcttgtcccaggtgctgtggggctggggaccaaggcagttctagactggctacccattcaggcctggccactcaggttgtagccacttgtgtcatttggtaggaaaagtgagaagttatgagccagaggtttcaattatggttttgccacttactgattctatgacttataaggttacttagcttcttggggtcagggttcactcatttaaaaatggtgatgttactaactacaaatataaatgagttaatgtaagcctccagtcacagcttggaagacagtgttttctttctctttttttcttttcttttttctttcttttttttgagatggagctttgctctgttacccaagctggagtgcagtggcacgatcttggctcactgcagcctctgcctctggggttcaagagattgtcctgcctcagcctcccaagtagctgagactacaggcacacaccaccatacctggctaatttttgtatttttagtagagacagggttttgctatgttggccaggctggtcttgaactcctgatctcaggtagtccgcccaccttgacctcccaaagtgctgggattacaggtgtgagccactgcgcccggccgcacagtgatttcttaatttatggttcatggagattataaaaattggcattttaattataagtgattgaatgaagtcagacattggagaactgaataaatggacacatttattcaacaaaggttgttgaggatctgctaggtgtcaggcattgtgcaaactggtcgagagaataagatattctctctggcttcatagagtttacatggtcagagagcgaggacaataaacacaaaaacatatcgtcatgcatattgacaagtccattttaaaaagaacagggaactataggagagaagggggcaggagtgggaataaattgtactgggaagcagtcaggggagtttttcttgaggaggcaacatttgagctgagaccagaaaagggagcaggaattaactggacaaagacggggaggagtgtatgtctcactacaaagcaagaaagagctacgcacagtcaaggaaggagaagtgaagccagggagtctgaattggatggccaagccagtgactggcatgaaggaggctggagaggagggcaagagcatgtgggctttgtgtgccagagaaagtattttacatttttgcataggcaccatggaagtgttttaagcaaggaagtaatgtaattctatttactaggactagatgaagttgaattgaataaaaggttactaagggtgcaaatgccatttttatgggaagagcttatgcactcaccctgagggctggcataaggcaggagtggcattgagtgtccttggctgttcctggctttggtccctgctgtgtgctgcagcctcagtggctgcagattctgcccatctaaagccatggactttcccatgaccagggcccattttgcctttgggtctgagaatccccaggagtgggaatccagaagatgtcagctctgtggcctgaactggaattccaactggatcatttcattccactattgattggaagaggaacagtaaagctgtggtgttagctggagtaaactggagttgagaaactcactgtgtatttttcagaaaaaaaaaataataataattcttaacaatctcaaactactctcaatattgtaagtcaccttgacagcacgaggacttgaatggtttgcctggagggctaacgatcttggctctcccaggtgcctgtccgcattgggagacggcgcaagctaagccagctgtgcatctctcctattatatcatggaccaggggaccatagacattttgaaagggaatgtatctgcctctctcacacttcagcctgcttgtgggatggcttggcccagacagcagcaggcactatgtcttttctaaatgttctgcctcttgatataagcaagcggtccgtgaagagatttatcagaggcccttgtgatggatacatgtcttcttataagctgatagtccaggggagactcctaaacaacaaagggaactgaaggcagactggcagcaattctagtgtcctacaaggctgtggcttgtcctgtgagctggacggcggggtctgaggcaggacgtcaggcagggccatgctgagagcatttcacatttattgaaagcctgctgtcctctgggcactgtgttttcctcttgccattccatttatccctcccagtcatgctccgctttatggatggagcagttgaggctcagaggggttacataaagcacccaaagacatatgggcaggaagtgacacaacctggatttgaatgcaaatctttctggctgtttccatattgtctcacagcctatcccagcatcgtgtgtgtgtgtgtgtggggtggggggggtggggggggatagggggtgggggctggtggtatttagggatgccctcttcttaaggatgtgtcctggggctaagtcattgttcttgggggtgcagggaagggacaatggatcggaagggtctcagtttgcctctggcctgtcagtgggccaccctcctctcctctgtgatgcaggggcagtgtggctgccttgccagcctgccctcctccagcctgctgggagcctcgcgtgagacaaccgatctggaagccccttagggaggacacagcgcaggagaggcagctgaggctctaaggacagctgctatcaactgccagcagccactgagggagaccctgggcctggcatggctacaaatgggctcagctccaagggaacagagaattgggccacatttgtctgggctgggtcagaaatggcagttcctgagcccatatcaccagctcccatttgcaaggctgaggaggtgcctgggcttgctgtgtgctgccttgctttcgttcccgctttttaaggcacatatcagcctgggcagctcttgacccacaaggtggactcttctgggccagccacgggcagtggccaccctgtcctgccaggccgcagaaaggccctgggccactcccaactggagccagtgctcctggagagagcagtgacctggaccagcagacctatggatcccctcttgctcctgcactcgcctgctccttgcagtgactcggcagtgggagtgggaggtgtcagagcaattaggcggaaactcctttcgtgcacctctaattttcgagctctctgaatctcattagttcccgggcttttctgctctgccctcctgttctttgcttgcagaaaatccagggggcagccagtcaccctgttgctggcggtgatgatgagaccccaggccagtggcacagaggcctcctgggaggaagtccctgtttgggcgcccagcactgttcagggcctcctctagtcctgttctactttaggccttaccttctcatttctgttgctggagcaaaaggctctgaattcagagttgggaattctcaggcctggtctgagatttgtctgccccaatgatgatgatgatgacgatgacgatcatgataatactacactaatagtagttaagagttaccaattgcctattctgtactaggagcaatttagacctcatcacatgtaattctaacaacatccccgcaagacaagcattatagtcctttcatagatgagaacatctgtgcttagagagattaagtaactttcagactcaaacagctggatggtgactgagctgaggtttgtacccatgtcttgatgactaagcccagctgtgcccaccgggacaccttgacctagtacttctgagagccccagggtcactattcagaggctcccagagctgccagtaccccagatcattgcggctccctcatcctggcagtgaggaggctcaggcctccgtgctagtgccccactccttgattctacccgtccctccctccctgtggcctgcagagattccgactgctgctttgtttcacccagagcacctcttctgggctgagtgctgtggaaagggccaggtaggaaaggagatttaaagtagcttgactcagtttctcccctgagtttccctttggagacccgagaaacacatctgggaagtgaatgggaagatgagaagaagtaagcaaaactgggaagagtgaaggccttggaagtgcagaggatgccggtcgtcccaggtgctccggggagtatttctgtttagagtggcatgtggagggagtgctctcctggtacagcaggcgtccaggcagagtgagactctgctagactcaactctttcttcttctctgaaggaatcagagactgaaacaaggatggcttcatcagtttggccatagcctggaaagactgggaaacccagcagctctctggcccctgggctcacagacgacatagttcttggaagctgtcatccctgcctgtgatgactgacctgcctcttgccaggcttccatccttgcttcaaggcctgctaatcatcagctccactgggagatctttgcaggctgccctggaatcatagctccaggcctttgttctagaacatctgttgcattgtattgtacctattgctttatatatttttcttccttttctccaagacaagaatgtgcactcattcaagcctgggatgggctcttcttatgtgcatattcagttccaagaaatatttaaactatcactagtgtaattcagcatccataatgagtttatactcttgtgtattgaaatcagatgactttcctgtctttgtggttcatattattaatattcttcttatcgctttgctctgcttagttctttttttatacatctttgcctctcacccccattttctgccttggcattcgtttgttctttcagcgaatgtccactgggcacctactgtgtgccaggcactgttctaggtgctggggatacagaaatgaacaggaaaattgattggcttatttatttgaaaaacacagaattagggttgactcagggtgaagcttgatccactggctcaacagtgtcacccccagagctcccatctccgtgggcactcaccctgtgggttaactgggtctttggggcgccatttcctggacatgcctcaagacttccctgaatgagtggttcatctggtaatgaatgaggccacacaggctcccttatacttgtccctggcgtgggagctgccttctaaggtttcataatgagaacatgcttttttaggggagcaggtgtgtggtagactctggactcctacgctgctgtcttctgattattcccagagaactgcacctctccgctctggttgggctgaggctgtttttgtcaccccacaggcctgtgttgtttgttcataaagcagagagacatctgtcatcctcactgagcccgacagatgccacattcaaagacccagcacatgcagcagcagcggtggcagcactgtcattgcggcgctcacacacacataccgacacactcgtttcttcttcctggcggacaaaccttcctgcccctccccgccaacacatgcttccacacctatgagattcaaaatagggtaacagcagaactgcaggcctgaagcacttgctggacagtgaggacacctctgggttgaggggacagggttaaatggggtagaacaggaagaatattcctcctcctgggtgtgaacgagtctcctttgatctctgcaggaagtgccttacccaggccctgttacctttaggagcaagaacttgaggaaatggtgtgggcacatgcacaaaacatggggcttacttttagcatgaaggggaaactgaggatgcccagctcattgtgtaagagagtgaaggtttgaccgagggtggcttctaaagcaaaacttagacagatgacgacagggatgaggtggcaggatccgaagacaaagaagaaccaggcacggattcactcgtacttgtaggaggaccttggacatgttttatgtaatacagaacatttcctcttttaggattgtaagtaatatcatggtagatgttactggaaattttatcactcccaccctgtgggtcttagcaggaatcatcctgaatggtgtttgtggacttgttttggagaagtctgtgttgagggcaggggtggtaggactttgtgttcaacttggcaggctcctggagggagagagtggtctgggacaggcgttagagggtcaggccctctgggcttaaaagagaaaaaggaagaggggaatgtcttggagaaggaggggccaatcacttgttaggtcctaggcagtgtcttggtgccatgtattagaagggaggtggagggagtggggaggtatcagcctgtagataacatcctgttctaatgggtgggtgtgagaaggtgggggagatgctttgagacatatttaataatatctactacagataagtcagtgaatcccactctttaccatgtaggcttatcaaagaccactagcagaaaaagactggtctaatcctgagagtttccttggaggacttcctcttagtgtagccccacctaaggctctgggatgttggagaacagccggagagagaggaccagttctgtggctctcagctaggttgcaggagtcttgggggtgggacggaggattctcagctgattttccctgcttttccttaacatcccccactgcttgaaggagctgttccacttgcatctttttcttatattgtgctttggctcaaatatttatctggaaaaagtcctcaagaactaaaacctttctttgtatcttgaatcagatcatttgcaagttccctctgactgtaagctgattttgtgacttggtgttcccgagacccccagtccacttcatctcatctttgatttttaagccattctgtctttcttaagctgacatttgaattcctaggtggttctttctgcatttcaccagcttacagttgtgactcatcctcctcatgttgttttaagtcatgaagagaatctgaatccagcaggaaaactgagagccatcttcataacagtgaaagtttctggaatctataaaacatcaatttgtatgtagaaactgaagtttaagaaagacaagcttttctcttaatttaaattattgcgtctcatgggaaatttaattttttaaataaatcacatattccaatgaagcagaaagctttgctagatacacagtgaagatgtttgctttaaaaattgttctttattcagctagagaggaaccaggggaatacaggaagataaaaagtgctgaatggaatatacaagacaaggttttgaaatcaaggctaaattaatcatctctccctttcagtgggctatatctaagcagaggctggcagatactctctgactgtcagatttgactatgttattctctaccagaggatgctaccagaatgactgtcccagggtccatgggtgccaggatctgttaactgatggcaatcttcacctgaggaactgcatgtatcttcagggatctcttgcatgcaagtgagacaactatggttcaagctgcttaagaaccaaaaaaatggggatgggaatttgatggcttgggtaactgaaaagcttagggttaggcttctcttcaggcttagctgattccaggcaatcaaatgatgttcttcagtctcttgctgtcactggttcactcatttctttttccatctcttacctctgctttcttctgtgttggttttatacttgggcagccttcttttatgtggatttccgtaacagaatcaaatgcatatcatattggcttcttacctttggctttcaatagaaagatagattctcttttatatatagacatacagtagttccagcaaaagtcctagaactcactctcattggatcaggttggttggcatgttgcttctgaaccaatcaccacagccaggaagataggtctcatagtcttactgagcaaacctgggtggatatcactcctggagatggaaggtggaggtgggcgcattcttaaaacagagggattgagagtggggaatagggcataccagaaggggcaatgaatgctagtcaggtaaagataatagctatccactatgatatggtttggttgggtagacttgagggaccagacctggggtgacccatgtttgcccagctgatcccattgggtgatttcttcctgtttgatttcctgcaaggtacctcagttgttggcatgattctcctgccatcttgctcctggatgttgaaaggccacacggtgtctaatttaccaacacagacctgatctagaaggcaaagacaagttctatgcccacacttttccaactgtagagttaagaagttatttctatcctccaggcttaatttttggctatcaatattgagctaaagactattgaagatttacaaaattatgtatcaatttaattttactataattaaacacattttagtgaaattcctgtagcttccgttattgatatttttcacaacaatcctctgacatatacaattagccctattttacaggagagaaaacagggtcagaatggtagagaacttgttaaaggccatgcaacctggagaatccagcatctatgtgcttgtgctgggtttgatgcatttagggatgaataagacattctctgcccttgagctgtatgtaattgctctgtgtttatagttacataaaagaatgagtaatatgcctctatggaagtaaaacagaaggaagtgattaattttacgtaaatgtagtctaggagacagaagggacattagagatgggtcttgatgagtgagtaggagtttcccacgtggatattgtgtacagggggtcgttttttcactgagtaatgcgtgagttttctatgagatggagctgccagtttcaggaaatgtaatgtcacccttgactctgccttctccttttaccagaaggatggccacagagatctacattagtattagttaggtgctttcatttgcaaagactagaactcctaacacaaataggcttaaataataaagggcatgtattgtcttatctaattgaaaagcacagaattagggctgacttaaggccaaacttgatctgttggctcaacaatatcaccaaggatctggcttctttccatctctccgttctgtcttatgctatctttcatatcctttggtgtctttatcaaaggctggcaccttttaggccctaatatgactgaaggagctcctggggctagatgcttccttcatcatgcccaacaggaaggaaatggcatcgtttccaggcactttcagcaagacctgagagtcactctgattggactggcttaggtcacatgcccatccctgaacccatcactgctgccacggaacagagaacattgataaagttgatttccctgaagccacatggatccccaaatggaattttgcagactgatggaaggaggaagtggacaacggatgctatattagtccgttttcacactgctgataaagacatacctgagactgtgaagaaaaagaggttaaattggacttacagttccacatggctggggaggcctcagaatcacagtgggaggtgaaaggcacttctttacctgacagcagcaagataaaaatgaggaggatgcaaaagtggaaacccctgataaaaccatcagatctcatgagatttattcgctaccacgagaacagtatgggggaaaccaccccgtgattcagattatctcccacggaatccctcccacaatacgtgggaattatgggaatacaattcaagatgagatttgggtggggacacagagccaaaccatatcaaatgctcagaaggcatatgttttggtaaggcatcaaagaaatgtttaccagagcactgaagtttccatagtctctcttttttgggcagtaaaggttctatatagctccaagacataatctttgatgctcagtctatgacaactcaaattctaggcctttccttggataattcagccactgaactaccttttgcttccctctgtagtctcttcttagttagtactctggacaaacttgctttgactttgtccaaagacacccattctttattagtatatgacgaattttgtggacagagaagagtgctatgggcatgatggcatacttaccacacagaatgatctagaactttgtagcaactaatgtcctaggccttttccagagctgctttcttcaaatggggcaacagacgtgatgccgcattttctaaagctcttcccaacctccaaaacagcttcttttctttctgctgaggaagctaaatttactttcagtcctcaaatggtgaaaaaaaggggagcctccccagatgtctcacactgataagaggaagaaatatccaaagccattagccagtggtgacaaacagtgtgtgaattgtaacggacgcagggtggctgaagaaaagactgagtggttggagacaggcaggcaggcctgagtttcaaatccttaccctgtcactttcagcactttgggatgctgaggcaggcagatcacgaggtcaagagatcgagaccatcgtgccatcatggccaacatggtgaaaccctgtctctactaaaaatacaaaaattagctgggtgtggtggcacgcatctgtagtcccagctacttgggaggctgaggcaggagaatcgcttgaacccaggaggcggaggttgcagttagccgagattgcaccactcactgaactccagcctgggtgacagaacaagactccatccccacccctccacccccaccaccccccccccaaaaaaagaggcaggatgccatggggttgaagaaaacaggccctgtagccaggctgcctgagtctgaatcctggctctactgttcaccaactgtgcctgcgttcatgtcccagctcttccattgactaagcctggatcaagaaataatccctgagttctaatctgtcattcaggtaattgcgttcttatgtttccttttgtcatttggccttccaacttagttgggatgatggtggctgtcactttatctctttggcctcaattgtttcatctgtaaaatattgatacaagtaatgtccacattataggttgttgtaaggattaatcctcatttaactcatttacaaattttatgcattatatatgtatatattatatataccttcatatatatggaaaacacttgtaacagcatctagtaagcacgaatgatgtggatagatagacatatcttatagggttgctgtaagccctagagactttgcatatatattgtctggcaatagcagacactgaataaatcttagctattattaataattattatgttgattgaactgtttaataataatgtgattcatctaaatagagctttatagtttctggagttcttgctgccaatatgatccttcttgagccctacaaccactcagtgatggggctcctattcctctgtccagtggctctcagggaagggttggatgcctctccagggtctcctggccaggtggtcattagcaggaccagggtgtgaatcatagtgaggagcttcccagtccagggcttgttccacatcctctcttcccccattctaaaggcctcccagccatttgtcacagcctcatttgaaatgcctgtgcttctcatctgtaatatcctgattgtcccattaatctcctttaagcttcatgaaaaatacaaggggctggatcaggaaatagccaccaagttctaattttgcattcaggggattgtcttccatggacgtgaagagactgatgtttcccatttggcctttgcctttccaactaagtcggggagagctgtcattttctgaattatcaaccagtttacaaggtggcatctatattttgcctctaatgtgtctgtacttttgttgcttctctatcttcatatcatcctctccctagtagatgttctacagtactgcccagagggagtggtaagaaatgtcttttgataaaaccttaaaagcttaaaacttccagtcactttcttttgcatattccttagaccctggccataggccagtgctcactacagaaggagcagtgtttgttttgttaacacacacacacaaacacacacacacacacacacacacacaccctgtactgcaagatcctaaattttagacttagttcactgttttatatggtagccactagacacgagtggttgtttaagtttaaatgaaattacaggttcagtttctctttgcattagccaccttttgagtactcaatagccatgtgtggttagtggctaccatattgggcagcacagatagagaacatttccatcaatcacaaagtcatatgggacaacatttaccataaaggggaaagggaacgggaatgggcacatgagtgtagtgttcagttaagtagcatcacgggacaacagatgtgaagtagtcctcttaactctctgcatgtatttcctctgtgatttccaaaggaccactaaccaggagaaataagaaactgttgttttctgacccaacaccagcatgcaatgaaagtaggatatttttcattctatagagaaccgtcaatgtgtattttgttatctgatttgaaccctgcacgcggacagcacatttcacgtgttttagcccatttgtggctggcacaggtgtggccagaaagccagcataggatcttgtttgtgtttaagagagaagttcagggagactattcaggcacattgtctggcaagtctagcactggtcaaaccctcataaatattcctgtccaatctgaacttgaaatgttcttgttgtggacacctttggtgagccagtctacttgaggacaatccagtctactagtttagcttcaaaaagcatgcactagaaacaattagaagaacagggttgcttttaaagctatcaggatggtgtttgctgttgttttgttgttaaatatcaatgggttactcaatggtaatagatctaaagagatgaacattgttacatgaatattgcaagaaatttgtggatctcttggggaccctccagacctagttttgagaatgactcatataaacaatttgcagagtctaattcatatactcagactagggttctgaattcttttccccctgggaggaaggaaaaacagaggataacattggttatctggggtaataagaaagcaaggggcagactacagctgccctaagatctgagatctgagtgacagagcctagttcagggaggggctgacatgctgctgaaatgggcttatccagccacactcagagctctagtgagtatcagggtcattgtgttctaaatcatctgtggccagcttaccaaataggctggagtctggcagagaatatctatagaattttccacaaatcagaaattctggtttccagaaggataaacttccccaaatatcctggtggtcttgagttaattgtggcttcctgggagtttctgtcgttggtaagggtcacattttcattgtcccttgacctttagtcttctcagagttgactggtaacattaaaatgagcatgtcttcacttctgtcacttacaaagctcttaaaaaatttataatactttaaacatatcacagtaataaaagcaatcgtatctctttacattgttgcagtcttttggataaagtcccctgaaagcattgtcctggtggttttcaaacttttttctttgatctttcagaatctttgttcaaatgacatcttggctagactccaacatatagcacagataaaaatggagttgggactgcagggagagaaagggtggagcccagctcactggacctctgcctccacccccaaaccaccctctagcctttgagtcaaccactgagtcaccggtgagcaatccctgtggttgcccagagcatcatcccactaagtcctcataatcaccaggcatgattgtgaggtcatcacagtgaattggtgcacccctggaggtaggaaggcagctgaagaggggagagagacaccctccccacccccatatgaggatggtctgtgatgatatgcatgcaggggaagggacttatccaaggtccctgatagatagggactggaattttggcagtgtcttttctagagtagaacaaatttatcagttgaatttgctgtagttctctgaaggtttctttggccacattagaatttttgagccctggcatccaagtaggccaacttcaaaatggctgtgtgctccactcagagattctgctgtgaagactggcaggagattttttagcctattctgaactccaactgttccagttcctcttgctttccagaggtgtgagcacctggaagcccctgctctggtctacaccccaggctcaagattcatcctgctcactcagccactcatgctgtcaccagtgataaaactgtaagtgtcagcagttgcatttgattcttgcacaagaaatagttaccctctaaagacttgttcattcttgtgcctgtaaagtgtggtgtgccctatgcatcagtattcttgcctatgaaatgggcatgtaggctgggcacagtggatcatgcttataatcccagcactttgggaggccgtggctggtggatcacctgaggtgaggagtttgtgactggcctggccaacatggtgaaaccccatctctattaaaaatacaaaaattagccgggtgtggtggcaggcgcctgtagtcccagctactcgggaggctgaagcaggagaatcgcttgagcctgggaggcagaggttgcggtgagccaagccgagatcgtaccactatactccaggctgggtgacagagcgagactctgtctcaaaaaataaaagaagaaatgggcatataaatagatctacataagactcactggaagtttagagctctttaaaaaaatggacaacaaaaagtttttccaaataaatgttgattctgggcctggaaagtttgagtggctggcttctcagagacagttactaccatccatgctctttaaagttccattgctcttattctaaccttgaaatcaaagaaaccaaagctgtggtttcttgtctgaccttggctaatgattttctgattgactctacatgcaaaagaactgctgataagtttcttataggggagaaaagatgatggggagaaaaggaactgagttcatttcctaacctcagtttccctgcttactcacccagtgggttgggagccacttgctgggtctgagtttccataatcaccatagaaatggaagtaatattatccttttgcccagtcgatgggaggatggaggaatgtcttagtctgtttggcctgctgtaacaagataccataaacttggggggctgataagcacatttatttctcacagttctggaggctggaaagttcaaggtcaagacaccagcagatttggtgtctggtgagggcccgctgtctggttcatagatggcactttcttgctgtgtcctcacatggtggaaggggcaaggcagctctctggaggctcttttataagggcatgaatctcattcatgagagctctgtctccatgacgttatcacctcccaaaggcttcatctcttaatataattacattggtgatgaggtttcaacgtatgaattgggggtgggcaggcataaacattcagagcatagcaaggagaattcagggattgcattaagaaagtaagttgctgagcaaagggactcatcttcaaagtccaatacaatctttataatcttacaaaaagctttcctggttttagaattagctccaaggaatttggcactagattttagatttgctcagagaaagagtgtgagagagagagggatgtggcttttgtgaggaattccagcaccttcctttgcaaagatatgccctaaagaacagtggcggcctatcctcaggacagaagcacttaattttgtctaattgtgtcaatttctaggagtcattgggaaattcagcagctaatgaagatggccctgttctgtcaggtccctactggaatatttaaaattctgtttttcatacttatcagctaaaagaattacagaaatatatttctggatcctgtggggaataagagcagaaatatacaaagcttcttctttcaagacggatcccagcagcccaagctaatgtcacagttgtgttaaagactattgattccagcaggttctgggctgggtctcagcttcccaggactgttccaggctgacctcctttccctggttccatctttttttgggacttctgtgggccttcattcagcatgtggcttgcgggtgtccaggtctgcaggcatacacacctctcctgatctgaatcagagaacaaaagataaaggatcgaggacaatggcctcttcacttttgctttctctcttctttgggttttactttgtgtttccaacagccaatggaaggctgttctatttagggtaaatgactcagacttggtacatctcgaatcgtatgtcagagcacactgttgcccctcaaagctcaggaaaggctgcatactctatctccctcttgatggtttcctcgtatttacaagttaaagaccatagatgtcctgtagtaaaggggttagcttgcctctgtttatcccggtgattctagtgaaactaaaatgcttgtttctatggggcacagtccagatgtgttgttcacttggattgaccaatcctttcaataaagttttgatgcaaccatgtgaatcccaagttttcagcacttagttttgtgaccttgagcaagtcacctaatcattacatgcctcagtttcctcatctgtaaaaggggataataaaaagcatctacttcacagggttgcattgaggattaagtgctttaattaaggttttagtacagtttctgaaatataatgtattctatatatggtagctattattatgttagtatccattattatttgctggaatcttttaacactgtgctgagtgttggtactgtcttcttatcatgtcatagagcatggggtagtataagaatcctaccttaggtcaaaggtcacaaagccctattgttttattcccaatagtcttacagggaagatgcagttgtccttgtcttatggaggaaggaggtgaagcacacccgagcggtaaagaggcccctggtcacacagcccatacaggagtcaaaccctggcctctggctgcaagcctgccatccccaagcgtctctctaaagcttcttgtcaaccagcctcagacaggggcccacagacacgaacctcatctcagcgttggtaggaggcaccttccacttggattctcttcatgtggttaagagagtcctgagttccaatcctaagttcactcatctctacctccttgcctttgtgcaggttacttaacttttctgaccatcagtcttctctgttgtaacatagggatggtaacacccatttcttatgcatgcagtgatgcttaatgacataatgtaggtggggttcatgcacaaggcctggtatatgatgagtgctggtaaatcttagctcccaatgacactgtatcaggctctgtgctagggtgctttacgaaaatgatctcatgtaatcctcacaacacatcaggatattggtactcttcattttacagatggggaaactgaggctctgtgggattaagggactcacccaaggtcataaagccagattgtgacattgagattcaaatcttggcaaccttactttctggaaacactttcccccttcctcttctttagacccacatgcaggctgcttgcagactctgtgcttggccatgtttcttggtcagcagggcagtcgggcaatgggcattttaatcatgtttatgctggacagggctgtcccttgggcttgaggacaatgttcttgaaccagaagaatatggcagaagtataatgccatttcaccaggacagatgcatcaaattccatcttgggtctggtaattctgccacagatggtggcccattgatatgtgcatgcttggctggggtgagagtctgtgccaatgtcacaggacacagcaaccccaatgagtctgtttacttatttaacagtcaaggtgaccagaagagacactttccaacaggacacaatgaggaggtacccagcaagtcttctagctgattgggggaagaaacccagtgtattacaggaaaatgagagagtgcatttgaatttgtttctaatctgaattttccatataaactctagttagcagtttcaaaactgtggacgcacttcagcctaagggacaaaaacaaaacaaatgacccaaggtaccagctgcaagatgctggaataggagggagggagggaaggccagtgagagggcaagattattaatatgcttttcttactaaattggctttcagaatcaaggggaagaaccaaggtgggttgttaagggagtactgatttagatgtgctgagcagttgaaatgtttttgtttctcaaacatgaaagcacttggctttgcatgactgggttttaaattgctcagcaaagcatcacttggggctaacctgagtctgtgaagttccacaattcaggaatgatggttactgcagcactcttgtgtttcaaggttcgtcatgaagactagcatagattccactgttcaattaaagcaacgtttaccatgatattcctattttccatgatgcagggtcctgggaagcatctctttcaggaagggagtatgtattcaaggtcagtcagtatatgaatgtgtctgagacttggatggctcaaggggatagagctaggtgttatctggcagtcgcaaaagtgagagatgatgacaaggccaaggtaggtaggagaatggggatccctcattcatttatcccatcattatttattgagcaccaactgtgtcccaggcattgttcaaggttcaagcacaaagccgtgttcaatgggttcaggtagaaacatgcacagttacatcacaacagagtaaaccatgggaactgcatggtgcagagtagggggtatttgcatggcagttgaagacctgtgtcggacgctgatgcttctataataacccaacttggttcctctccacttttagagccaattaattaggaaaaacactttcttccttccctctctgtcattctatgttggcatttgtcccccttgggttgatgggcagacacaggtatgaaacccataacttcatctctctgggattcagtttctgggcagagtgggcaagggaggccagggtcttctagactcactaagtcagaagcatctcctcctgatctttggtttaatttttcttttgaaggtactcagtccatgatttcagattagggaggcaccacctggcaaagggggagcctgacaatgcagggcagttctaagtaccaggcttgggaccgattctatggagatatggtagatgggactaccctcaactgaataatgtgtgaagagaatttaagaccatgcctgatacatagagggtccagtgaaagttgaaggcaaataaccctggtaaagaaggcaggaaacacaaggaagccattcatttatttattattcattcaatcaacaaatatttcttaaatatttataccaacaaagcatggaacctctagccaaactctctggtttcaaatcctggctgttttacaatatctgtataaccttgagcaagttacttaattattctctgtgcctccatttcttcatttgtaacatgggaataatcaaaaagaataaatgaagattgttatgaagactaacacgtgattgttattattatctttttgttcatttatttagctgtgtccttagtctgttgcttgattggtgtggtgttggggatgtggccaacggagacaggaaaggtctccgtctttacccaccttatattacaatagaagagtcagattataaaaaaataataaatcaataaataatactttaaggtagtgatgagtgatgcaggaaacaagagaagatgattgtggagtgagtgattactacgggtgaggtccaatgatagagaggactagtgaagagggaagacagtcagtctacacaaagatcatcctgttgaaaaatatgaaatatgcaagtctttggaatttacccaaaaaaaaaaatagagaaagcatttcttgagtttccaagagaggcaagcaggatgagccaccaaaaataagtacggttaaataaagattgattctgggaccaaataagcttcaagataattatttctcatggtagtgaatcagtatgtctcacaaatgcattcatcttttcatgttttcagtacccaaggtccttgatggatggattaatcctccttttcaccttgcttccttcacctgatccctcacctctcaatgaattgaaattaaggaccgttcatttggaaaaacctattaactccctgcttgtcgatggcttactttctactcagcctggctgggttccacctcttagctcgtgagccctcacgcaactctgctgtctccattagtgtcccttgtgggctggtggccgaggcagttaggcttatgaatattccagttgctcctgtaaatttccagcatccactgttaggcaggacatgaggcactaagggatgtgcatcacttctgggctggggcaggggatgcctgtgtgtggtggtgcagttgctgtcttccctgatggcactgaagagactgtggcttccagggttgcagtgcaagatggcggagcttctgatgcctaggcccatgagtgggcaggtggagcagagcccaggctgcctttgtcttcataggtctctaacttcttgacttctcaatagcctcaatgactggttccttcctgtatttggtaggtgattgaaaacctcttaacacatgaattattcagtcttggctaggccttctcctaaacagttgtctctggttcttaaagttaccttttcctcctctctaaaataacttccttaccttttcctgccacggacactatgacctcttggttttattttcttgattgtatttggcattctctgaaattgtcttatttgtacatttatatgggatttgtgtctcctcgctagaatataactcttatctatttatactccactgtatcctcagtgcctacagcagtatctggtcgaaaggggtgcctgataaaaatgtgaatgaaatgaatgccaacagccaggaaggcacctcatccccctcccctctgccaccccctttatcagggctgggctgtgtcagctcattgaggcagtagggagtatggttaggatgatggactgcccgggctcaaacacaacttcccacctgtgtgatcttagataaattcacctctctgtgcctcaatttctttatctatacaatcaggacaatggcaatacctatcacatggattgtttttcagtttaaatgagttaatatacataaagtcctcagaaaattatctgattcatagtaggggccatggaggtattaccattgtcaacagttactggggaagcaaagggcctgtcctctctctggtaaccccccgacccccttcagtctcttgagaacccggcctcaatgctcacctggggtcccctgggatccattcagcaagaaggttcagccacaccaagccctgttccttaagcccaggagacataaatccacaaagcctacaggagagatccctgaggaaagtggctattctggatggggccagaaggttctttctcaaggtcaaagctctcggagacctgatgaggccctgcccctcaagcttctgtcctttccacagccctgcagcattatttccataatgttattaaaaaccaatgtgtgctggccagatgagtgacacttcccagtgatggggctcggctctgctcctccaggcatggagaacttgttcaattatgtgccaccccgtgatgggcccaatcacagtacacacattagcttctgattatacccttgttgagtttctcttgacaggaaggaaatgaatttacctcgtgtcacctctgtagtttgcaagcaggcatggcttctgataatagcacctttcatgttttgtaagaccaaggagaagcattcgtgtggtggccagtccttggtgaccctttgtctcagcctggaggtgagcttgagctgattcttcatgggagtgtttactcctggggcttgtaggaatctggctgggggttgggtggtcagctgtcccataagattgtgggccttggccactgcagcatgcacatccctgaatccacactcttatggtatcgaggccttgggcaaatgactgaatttcccttgaccttcccttccacctgtaaaatggggacaatgatagtagttatctcacagggtaggcgtcagatttaatgagctaatagatgcaaagcccttgcatgtgcctggcatataataaatgctacattgtgtttttatcattaaaattatcttaatattattttgctgttgctgttattattgctgttgttattgcttagattggaacatgtctttgctatttataactgtgtgaccttgaacatatcacttagcccccatgtgccatgacatttgtaaaatggggaaagaggagtctgttccttggtgcagctgcaaggatgtcagtaggttggcacaggaaaggcctttgaagcagcatcagtgcagggcaagtgttgtgggttattattggtgacttgctcccctcaccagaggggtcttttgggtgctgtggagccagaggggtctgtccatggtgggttaggattatgcacttaggtcttgctttccatttgggacagtaagcatctgagagaagagtttgtccctgactataccaaattccaagttctgccaaggaatcctggggcaggccagaaagggaggcaggaatggagccagtggtggacccagcgtttccttccaaagcttttagactcagctgctaaagccagtcatgaagtggacgtgattcctgaggcagggcagcaggcccctctctcactacccccttcaccagccccaaccttcagcaacttttcctggcaggagaccacatcaccatcccctccccttcccatcacaggcatttcagaacacaaggggatctgggggacccacgtctaaggaactgtgactgagagcctgggaagggctttctcttgacctgggagagggaaaattaggcaaattgctgtgtttctccactgtaaacctgaatgggaatgagggaggagggagaaaaagccagacaaaaatggagacacatgcagagagatggagaaacagagaaaggagaaggaaagagctacagagataaggaaatgagaaaacactgagaaataattgggaaatgagacagacaagctcatagaaggacttagacccagaaagggaaagtggaaaattatcttgacagctaacacgtattgagaagacagtatgtgccaggcactgagattagtgtgtgatatatctcatttaatctttgcaacaattctatgagataagtgctgttgtcaacttcattctacagtgaaaacaacggacatacagaacggtgaggtgtctaagatcacacagcttttgtggaggagttaggactagaatccaggtcaatttgagtgcaaagcccatgtgcttaaccccctgcagagaggccatgaccctgggacctaaagcatggcagagcatctctgagtctccctgcactctggacattgagaagcactagtcattctgttttgtagtacagatgtgtttataaagagactccagggaagtcagatgggtaaggattatgcctgtcactcttttttttttttttggcattttttaaattatactttaagttctagggtacatgtgcacaacatgcaggtttgttacatatgtatacatgtgccgtgttggtgtgctgcacccattaactcatcatttacattaggtatatctcctaatgctatccctgccccctccccccgaccccacgacaggccccagtgtgtgatgttccctttcctgtgtccaagtgttctcattgttcaattcccacctatgagtgagaacatgcagtgtttggtttttgtccttgcgatagtttgctgagaatgacggtttccagcttcatccatgtccctacaaaggacatgaactcatcctttttttatggctgcatagtgttccatggtgtatatgtgcacattttcttaatccagtctatcattgatggacgtttgggttggttccaagtccgtgctattgtgattagtgccacaataaacatacatgtgcatgtgtcttaatagcagcataatttataatcctttgggtatatatacagtaatgggatggctgggtcaaatggtatttctagttctagatgcttgaagaattgccacactgtcttccacaatggttgaactagtttacagtcccaccaacagtgtaaaagtgttcctatttctccacatcctctccagcacctgttgtttcctgacttttgaatgatcaccattctaactggtgtgagatggtatctcattgtggttttgatttgcatttctctgatggccagtgatgatgagcattttttcatgtgtctgtgcctgtcactcttgacttctgtgttagttaggattccttgggcttcatgtaacagagagaaaagcagtttttcctacaagtagaagtctagatgtaggggtttctggcactagtgctgctgctacatcatgtcaagatagtgtctgtaggatgtcaggattcccttggcttttcactcatggctgcaagagagatggagagcttcagactttgggtccatttcaaggtagaaagaaaagggggaagggcaatatcaggttaagctgttccctcctgctttttatcagacatcttcccctgcagaatatgtggcgtggccacctatagctgcaagggaggctggaaggtgattattcagctttccatcttcgaggacaggcaaggttggactccaccttgggtgagccaaactgcagtgtcagccaccttccaacaaaccagcctaagcccaaacccaccagtaaccctcccctagtggagggaaacatttagttctcttgggagttgcaggcaggtctttgacttgaggcaccattctgagtcaagctgggtggtggggaggtggggtgaggcaggagtgcctagctctgcttccccatggtgttgctgggggtagatacaaacacagtcacatctgctatgtctggaaaaccaagactggagtctctcagctctccagtgcctgctttccctgtagccaattgcaaggctgacatcccaggaaaggcagcagattagatgagcacaggagcagagaggctgggaaggcggtggaggagggagaaatgtgggtttggcagaattttctaaaatatcactttattgatttggaagagacacaagagaggaaatataagagacaagtgataagaggctcagctgagatgggcatggaagagcctgccttttttttttcctttattgcatacctatggagcttttctaagcattaaaaaaacacttccttaccccctccccatgagattttaataccacagatacactgtatatctgtgtgtgtactctgtatgtatctgtgtttatacataaaggttgttttttcacttttcaatgtctgccttcctggaggagactttgcccccattgagaatacatgcatgagacacatctctagagacgcatctgggcttactgtgggaggagaagagctggtcccactttgtcaaactgtcttgtagacaaagggaattgagaagagtcttacatttcttgagcacctgttaggtatttggcaccaagacaggggctttagatctgacaactcacctgatgcccaatggcagttctgagtggtcagagcaggggcctcatttcacaaatgacatcatcaagatttaggggttcctccctcctttgaagagatccaacctgcccagatgaacaagctagcactattctgatgacagggcatggttgagtgtcagatgggttcaaagctcgtaggatgagcacagaataggctggagtctgtagtggtcctccctggaggagatggggtgtgaactgagctctgcaggacagacagatgcagagatgagaaggggaggcagcacctgctggagaagagcaggagcagaggcttagggtctgtaagggcctctggctgcaggggaggattttcgctgagagctgagagagatggaggcagagccatcccgggcaaagagaaaaagccccaccctggcatgtttattcctcagtctctggttgtgatgtagtattgagccagggatccaacccagctatacttagcaccatttccagaaggcatgagggcgggagatgggtatataaaaggcaggagtctggggctcctcactcagaggcttctgaaacctgagtggcattttcagtgtatccctgtggaggaaatctccgaaagaaggtagctgagtctgtgaccaaagagaggcttgagtcctgtttccttttcactctcaagagccttcaggctcactcaccccttcccttacagatactttgctggagctcctcctgacatgattgtattagtaaagagaggcgccaataacaaatggcccccaaatctcagtcggattctgcaacaaaggtgtatttcttgcttgtccttcatgttctgtataggttgtactgaaacccctgcttctggagccattttcccccaagattcttcattttaacatgtccttccatttgccatactgcaggaagaaaacatggagaactgcacagctcctaaagtttctgccaaaatgggacatatgccacttctgctgatgtttcattggccagtgtaggacccatggcttagcctaacttcagagggtgcagggtaatgtaatcctgctgcatgcctaggatgtgaagagcaggaaatatttgtcaacagcattaaacatgaccacagtgattataataaatgatttttcaatatccagttgaaatgatttttctgtttcttttctttttttgacacagagtctcactctgtcacccaggctggagtgcagtggtgcaatcttggctcactacaacctccgcctctcgggctcaagcgagtctcctgcctcaacctcccgagtagctgggatttcaggtgtgcagcaccacacccagctaatttttgtattttttagtagagaaggggtttcactatgttgcccatgcaggtctggaactcgacctcaaatgacccgcctgccttagccttggcattgggcctctcaaagtgctgggattacaggcatgagccaccatgcccggcctagtgtttcttcttcctctgtaatgctctgatggtctctgcatcagtacttatattatgcttggtaaatatttgtcttcccatctaaagtcaaaacattagggacaagatcctgttgaatgagggagctacaaatacttattgaggatccactcactgtataccaggcacagtgctaggtacacagagcaaactcccagtcctacaaggtggtggatctaatgacgtgacagatgacttgtctccgagttctggaacatcctgagcatgttctcatcccagcactgactagtccaactacttgttgattctctaagttagaattgggagatgtgggaagcttccagaaagaggtgacctgtgacctagcacaggctctacccacagcgggagcacaatgcattcttgaccttcacaatgcttttgacaatggttcattcaccctccatcacacttgttcctttcagtagggcagatattgttagtcccattttacagatgggaaaacagattctaagaggtccatcagcctggtctgcttagttctttgaggatgagtattcatctctctggctgtgtcagctgagctggacctgccgaattcaatcttcccatcactcagctcccaatgccatcagtcaagtgttatcaaattggtggagcttaaaaatgacagccatttgaaattgagtagaatttggtattattaaaatagcattctaaattttaatcttgtgcatcgactttttaatagcttctactttcactaaaaattgtgggccatgctcacagacattcaatttaaatactgtcaggcaagactgatttctcttccaacattgccagatttttcttttttttttctttctttgcattcatcttcttttttttttttaagcattgagttaatttttcactacttggaaatttcacagtgtatgaaacctcagaaaaagaacatatctttgtgtacagctcttttattctttgtcttctgttctgtagccttctttctagcctatctgttggttagggcaggatcctctgtggaagctaggtaatggttaattttctgggacaccttttctcatcacttcttccttgtcatgatgccaaacaagtctcgtagtcaatatcagcaccctcccctgcatgtgtcctttcaacacttaatctatctagcacttaaaaaaatatctgggagatgctggccatctatgaaggaggtttctcccttgctgctgtgtccattactatttttttcccaacttccccctgcatctgctgtatgcattactattttttcccaacctgtccctgcatcttacctagttttcttcatcctctcattcccatcccagtttctcaccttgaaccaagattggtggagtggaaatggagggcaaggttgatgaagaggagggacaaggggtgatatgaagtgaggagcatgggtcttggagtcagacctgaccgggcttgagtttcttcctttcccagttgctaactgtgtgaccctggaaaagttgcttaacctcctagagccttggttttctcacttgcaaaatgaggttagtggtacctgtcacacagggttatcatatggatccaacgagaaagggtacataaagtgatgctgagtgctgtggttaatggcatcatagccaactggccactctttcctctcctccactctgcaatttctgcaccccagcccagcagttctcaggtctagttacacattagaatcacctaggagcctttaaaaaaggtgcaaacatccctaggcctcactctagaccaattaaatcagaatctgggagtgtatacttgtggcatctttacttttaaaattttctctaggtgagtctgatggatgctagggttgagaacaactctaagtccccagggttgcctaaagtccaaaaacacttttcttttaagatcagaggaatcttattttagtgcttgtgggcagatctctcattagtgatggaatgggatttaaccttccttggctgtgcctaggagaaagagaagaagaggcagtgtggaacagggactctcagtgggtaagcccaaggtttccctttgttttcatcttgggacacctatttacccctgcaactataccgcttgtgcttccataaggatgaggacgggaggaggaggaagatggggaaggaaagagcaggaaaaggagggaaggggagaggcttttctcatgggaccttctccacactcctgtgcctgctgagatgtgtcccctcctctgtactctgaaaatcctttagtctaaccctgagggtccaatatgtggccagtagccacatatggctgttagacacttgaatatggctagcctgaattgagatgtgctgtgtcatacatgttccaaaactaagtaagaaaaataatctcattaataaaactttaaaaatattggatacatgttgaaattataatatattacatatattgggttatgcaaaatagtatcaaaattaactttacttgtttatttttcattttttaatatgagtaatagacaaatttaaattagctatatagctctcattattatatttctgtcagacagaactggttcaacccgttgtttgacactgagtgtatgtttcatgtgtaaatatgtctcaacgcttgcattagatgggcagtttgagaacagagacctcagcatcccattcattttctggcccccaaacacctattttcaaaatgccttgtactcagcaggcagttggtaaatgttttctgtaattgtgaatgataacagtgatggtagtgatgattgtggtaatgaagaagatgatgtaataaagctcaaatggtatgttggggccaaattacaaagatttttgtaagaaaacagtgcaaggtggaatggttacatttttaagaccaagcgccctcaaatacaccttaatttttgattaatttacatatataaagacccttgatacacagaacaaaaacatcttccatcatttctgtttagagatagagtgattcttaaagagtcttacaatgaactcccccacaaaatgctcagtgaactcttgctagggaccagttctaggtggtgggagtagagcggtgagcgaatgagataaaaatccatgccctttggactttacacagcatgtgaaaataaacacatttccaagtaaagtgcttacatgtccgatagtataataagcagcctggtggaaaatcaaacaaggcaaaggaaaggaggtgtggttggggcaggcagggggcatgtgaagaaggtgaacaaatctatgtgggcttacttgatcttattgtttcaataattcagctaatatgtttctttattcatttattcactcaacaattgcatatactgaaatcctattatgtcattcaagccatggtgagacaaggaagtgggtttcacctcccaaggagcgcacagcttactctcagaagcaggaaaacgtgccaattacccatcacactcacatcgtttctaaagtagatcctcaattaggcaacacttcagcagctgcggagtcactccgtagtagtctgaggcaacacaagtgcatctcatctgaaatatcctctaatgcaggatatactggagctgttgcctagggagatactgctcaaggaatatgggttccacaagcaaatgctatgaagttctagttattattttgagcccagaatgagttgaggcctaaaaatgttgccattccattaaaatgtgttagtttgaatttaggcacaaatgttatttttgaattataagcatgcgactcgtttatagtaatgtagctttgagaggactttgggttatttgccaggccattctttttccttttcttttcttttcttctcttttcttttcttctctttcttttcttttcttttctttctttctttctttctttctctctttcttttttcttttttttttttttggtagacatgggtctctctatgttgcacaggctggtctcaaactcctgggttcaatcctcccaaagtactggacttacaggcatgtgccaggccattcttgatataagctgtttctcacccatttggtccaaaaatagaggagacaataggccctctgtccagggcaatccaaggtataggactcacatcctgctctatgccatctataccattgctatttgccttctcgaatgggctggcagaaccgagaccttccttgaccagatgaggccattctggagctccaagcaggaagcagaatgaaaacatgtgtttgttttactaaatagctgttgcatgtgttggatgtaagagtcccccttgcttaaagagaaaataacctaagaacttgctcttcgtgcatttcacctttagaactagaaaagctgtctaattagattaacacacaggtgcatgtatgtgtgtgttagagtatagatactgctaaataagcccagtgtttctctgcatttgtctgaattttggaaaatgggatgaggctgattaagtggctttcatctgagagctgtgtacttctgtggttctgtttttctcctttgaatccctatcctatctcatttggcctccttgctgtgatcccatggatgtgttcaagtgtactgctagttccctaccactgcaaaaccctcctagctctgcctggtgaccccataaatccccagtgttccatgcctggtgctctggggagggaagcagatggcagggctgtccattctgccacccagtgaggcaggaggtcaactagggtaacagcagcaggtggggaggtggggtttctggtctgtgcatgcaggggacaacagatcatcaatgatccatgggcagaacagccctcatggaactaacactgctggcagaaggtggcagcagctggaggctgcttcagctcttgatcaagcacagaataatgttgggtgggtggctgagagttgctgcatttatgaattgtcactcagtggcagcactgaggtccccaagctctgtttacaaatggattttttgctcaaatgtttccttaactcagagcaactctctctcctttttttccctctcatcccctggccaactcctgtgcacgctttaggtctcagctttgggccccaaattcaggaaacatgttcctcctctgtgttcccttacccctgcgtactcagcctatcgtactgtaaatgctatgtaatctgtctcccacaatgggctgtgccctcgtaacaacaggggttgtgtcttgttcctcattgcattttcatggcctcaaaatgtatatctagtgctgtcaatatttgtagacttgagtggatctcatctatgtgcatggtctaatttcattaattatagacaaaaaggaagtagcagcttgggtaaccaaacaagcagataatccccaatgtatttctttaaggctttgcagtgctccccagggcaatttgggacaggggacaggttacctattttatatatatatacatatattagagatgaggtctggctctgttgcccaggctggagtatagaggtgcaatcatagctccctgcagcctcgacctcccggactcaagggatcttcacatctcagcatcccaagcagctggaaccacaggcatgcaccaccatacccagctgattttttttttttttttaaaggttttgtagagacaggcccatgctggtcttgaactcctgggctcaagtgatcttcctgccttggccttccaaagttctgggattacaggtgtgagccactgtgcctggcccattgtcatatttattaagtaaatatgaggacttaagtggtatttgaatattgatatttataaaataccctccactgccttcctcttcagcatcatttcatccttactggctctacctactcaaaacaggaatggttgtttatggaagtggatatgtttaatggaaattcatatgtttcactgacccatggttgccatcatgccatatatcataaagcacttttgtataaattaaatataaggataagcaagttattgctcagattagatactgtattcctcatgctcagacctgctgccagtgtcagaggcctgagagtatgccagctggggtgggtcaggccagcgtgggatttaaaagttctctagataagccacatgtgatgattgagctctctctctgctgttcaggcatgtggctggcaggtacatggggggcagggagaaagacactggacttagactggagccagtgtgttttatggcctccttagtttagattccgtgtggctctgtacgttggagagggaatggggctcccctaaccatagtaataataacaataggaccctcctatttaatcccatctctgtgccaaacacttggctcagtgctctcccacattattgcatgccccagcatcctgaatggaaaatactattttcattttacatgtgaggaaactgagtcctcacaggttaagtgactttattgaggtcatataggtaataagtgttaagattcaagttctcccttgaacttgagttctccctggctgcttttcccactaaactttgctgcctgaagagccatcctgggctgttctgattttgccattcactgatagctgtgtgaattttagcaagtcatgtcaatctctaggcctcagctacctttctgtataatcgggagatcactaaccgcctgctttggagggatgttaagaagattgaaggaaccaaggtgcatagcagtatttacgaaattattgtgagttccagataaggaggggtcattgccattgtttgtatttcatcctgactcctggaggctttaggttgtgggctgggaacactgaactaatattgaacattcttccaaggagcaaggcaatggagatactaaccttggtgatctgcacagcttgtgtgagccccgtgggctcctctaaaattgacagaatgatgaggaagtgagtaggagtggccccaagcatggctgggtaagggagtggagagtggctctgttgtgatgtggactgagggtgtataagctctctgcagctttttgggaattgtggccattatgtttttactatctcccattgtaagaaatttctgaattctttttatggtgaactcagtgggtgggtgggtgagtgaacaaactttcttcagatcttacgtgatatgtccacagttttctcaggcagaggatagaaggggttagatattagaaacagtacaaagaaagggcacctgtgcaaaccaatatgtggttacgtctaatttggaacaacaacaataataataacaataaaactaattataatattaacatttatccttactggggttgtacaatgtggcaagcactttttaagctattcgggtgcattatctcatttaatttttataataaccttatgaactaagtattatttttgttatcatttttatagatgaataaactgagggacaaagaggtgaagcaatttgcccaaggtcttatcctgattagtgatggatttaggactggaatcagaggttaggattgaaatctcagagccttgctcctactaaatattttctgccatgtctttgcaataaatgagggaatagaagaattaaattattttcaggataggacattcgtgttgttcaatttcttattatccagaccaacagaggggaggtgttttagttcatttgagctgctgtaacaaaaatacctagactgtgtggttgacacaaaaacactttttacagttctgaaaactgggcaatccaagatcaaggtgctaactgatgccatgcctggtgatggcctgctttctggttcatagatggcagtcctctgactgtgtcctcacctggcagaagaaacaagagggccctctggaatctcttttttaaagacagtagtctcattcatgagagatccttctcatgacctagttagcttccaaaggctttgcctcctaatatcacattggatgacaggatttcaatatatggattttgaggggacaaaacattcagaccatagcagtagccaaagaccacacaagtgatttgtgttatttctggtatgcattatgaagggttttttgatgattttagagtcagggtataagaggtggggaagcccaatgactaaaaatatagatatatattgaccgggcgcagtggctcacacctgtaattccagcactttgggaggccgaggcagggggatcacaaggtcaggagatcgagaccatcctggttaacatggtgaaaccctgtccatactaaaaatacaaaaaattagccgggcatggtggcaggcgcctgtagtcccagctactcgggaggctgaggcaggagaatggcatgaactgaggaggtgaagcttgcagtgagccgagatcatgccactgcactccagcctgggtgacagtgcaagactccatcttaaaaaaacaaaataaaacaaaaacaaaaacaaaaaatatagatatatatttattctcaataattttgtttatttgaacttgatgtcgaagagtctttctgttttctccttggaaatgtctcagaagtcatgacctcccatatatgttttcttctgttatcttttgttgataccatttgcatcagaagaggtcttcaactatttgcaaaagggaaaaagaaaagtcatgaccacccgtcagtctttgtccacttgtctctttcaggaccacggacaggggccaaggtgtctgagtagacaaacattttagttaagctacgcctgtgttcttggctcaggttatcttctttgaggccttttttctgacttttataggatgtcacactagcactgcctgagcacacacctgctgacatcagagtggatgatgctttaaacattttccaaggataatctgcggatgggtaactggtcctgtggcctcgttgggacttgacagtactggccctctgacttgcagtttgacctgcctgcctgagattttagtgtggttggtgccaagatttaaaggaagtgataagcacttacttgttcttcagcatcattaaatgataatgataacatgggtgatgacaattacatatttattgagtgcttactgtgcgccaagtactgttttgcatgtattgttttgtttaattcccaacaacaaatcttggggatatgaatagttttagatgaagaaaatgagacacagacagatatttaaaatgtgcaagacaacccagttatgtcataaacagtggagcagagtcccactttaccttgaggtcacgttgtgtgcactcccacaaggtcctcagggtggaaagggaggggctgacctcttcagagtgcctatttgtgtgctttgtgaatattattatactcaaagcctatttcctggggttgtgttgacataaaaatccccactttatagtagaggaaactgagagagcatttaagtggcttacctaagatcgcacagactatacatagagaagccaggtttgtctgtcttgaaactttttttttttgcagtgggctatttactatttatttcccagatggctctttacaccattgtgggcagtcctaccttacagtggggtctggtttctcaccttataggaggatgtggttgatacttgataagatttgatactggtcaggcgaggtggctcacacctgtaatcctagcactttgagaggctgaggcaggcagatcacctgaggtcaagagttcgagaccagcctggctaatatggtgaaaccccatctctactaaaaatataaaacattagcaggatgtgatggtgggcacctgtaatctcagctacctaggaggctgaggtaggagaatcgcttgaacccaggaggcagaggttgcagtgagctgagattgcaccactgcattccagcctgggtgtgacagagcgagactccatctcaaacaacaacaacaacaataacaacaaaaacagcagcaaagatatggtgctcagtctcctcttctgcttgggattcaagcttgtctagacaagaaggtggtgaagctcttgatgacagggatggcgggtgaacttgtcttaggtgtgcaagtgtggacccagaagcaaaaatgggtatgctgtgcagaagggttaataatcacccccagtctggatcattttgctgtaacatctgctgctaacccactgctaggagggggaatgccaattgtagtgctgctggagtagattttaaaacagaaaacatttgtgtgttgaagtgaggactggcgttctgttggttggatgacataagtcccaatttcttccatttccccatggtgtgcttgcattttggggcccaggtatactggggagggatgacccatatggatggagtgtaggctcactttggtgtggactagtctcactaataaccacgtaattatcattgctagaaaggactacagatcattctggaaaactctggaaaactcatttatttatagctaaggaagctgaggcccaaagtggaaaaacaggactgaaagtctgcatttgactttgaatccaatgctctttccctggtaacgtgattaataccaataacatgaaaatattatcaatagcattaatatggtcagtaaagcttccaccagaaataagcattgggccatatgttttgaagtttgtcaagaccactataagcagtggccctttccctcaaagaaggaattgacattctgggtcttgcaatataaaacagagatatcatcatcattatcactgtcaccaccaccaccaccaccaccacgctcgtcctcaccatcagacaaatctattttcagcacttactgtgtgccagattctgtgctatgtgctttatttatattgcatcataatttaaaatttatggcaaatctattgtgaaccatccttgtagatgaggttcagaggtgtaaagtaactattacaaagcctaccgttatgaagttccacgtgggggatgcagttagagaagacaaaacagtgtagaggcttcatggtggtgagacttgtgggggaacctgagctaagctccagagagtgattaggacagagaaaacagatgagatgaggaagacagtcctgtcaggagcaatctgaaggatttttgcagtgagggaagttgtgggttagactcagggacaatttgtagagaggtctgagtaaggaatgaatggcttccaatcactactgagcacatttcctgttccataccccatgtaaggcacagggtgtgcagaggtaagaggcatggttcctgtccttagaaatgggggggaagaaaccaaaacagtcaacccccatcctggataataagggttgggcaaagggtaaactcaaaggaccatgtgagttcagaggaatggggtcaaactcattcctcagtggcttgctaagggtttggctttacattaaaagccagagggagctacagaagtattctgagttaaggagtgacctggccagatcatctaactggggagactctgcagatactgtggagaatggtatggcgacaaggagacctgttggggcagcagaggcaagcacagcaaagccccccagcaacaacagtgtcaatgtcaatgcagagataaggcagaaagaagcgatcatgagaagttagaatggatagggacttggtggagggaggaatggggatgggcccagtgggcatccatgggaaatgcatttggagcctgttggtaactggccttgaaggtcatcctccctccttgcctacctgttcttggcttgtgagtaagtacacggagaacatgtgttagtgccatcccctggcttagtcagctacccaagctgtagcccaaagcccagagctccccaaagtcagagcttgaggctgtcccaggatatcactccatgcaaaggctgattccactttgcggttggactggttgtgtttgcatttactgtgccagccacacctgctctcctcgacgcccagtgctgagcctaggtggctggtgaagggcagacttccaggagcctggactcactgtggcagggaaggaggggagaggcacagctggtgccaagaggatattaacctgacatttagcaaaagggtgaatctgtttattgttctgtaacaatgaggcatttgcatcctgagtcgccttctgttttcctattgtctttgctcctcagtggtcaggccaggctgcagtcttgacagtttaaatcagcatggtaatgaaggggtggcacctagtcagttcaaaataaaaaatcaatctcactttctttctctgacacacacacacacacacacacacacacacacacacagagagagagagagagagagagagagagagagagagagagagagagtctagagctatactgagtgtccagaagttcctctctccagctccttccttgatactcttaaaattgtagtatcccaacccagataacttggaggtttggaaaggggacccctgtattccttctgttgcctccaccatagcctggctttccagctaccaacagaacccacttgtaggcaagaagaagcatgaattgaagtcctgatgcatgcatctaggaatgctgagaacgtgacagaaaagctcttacacaagctgggcatggtggcacccagctactctggaggctaaggttggagaattatgggagtttgagtccagtctgggcagcatagtgataccctgtctctatacagaagaaaaaaatcagacattcaggttgaaaatttaaaaaaatattctctatagcttcataaatattttagcattgacagggcttgtgtgcttttatcatctcacagtggtatagtgagctgggtgggagaggtgtcatgctaggtgaagaagctaagacctaggctcttggatgtttataatgtaccaggcttggtactgggtactttaatggcatgacatcatgtaattctcactaggatacaatgggacaggtctggttttcccattttacaggacactggaaaagtttaagaatgttttcagctgggaattggcagagctgggaaggaagccatatctacctgaccctggagtggccactccactactgtgggttgcatggacaggtctggagagtgggcacagtgttcagttggtgccatgctgtctgctctccatctactccagtagcccacagtggcttgcaatgaagccagatgttctggagaaggaggaaacactcttttgcttctgtgcccatccttaccaccagaatccccacagaagatataacttcttaccctcttctttttcccaaattagatctggtaagtcagcatctgcataccgacctcaggatcatttagaagctcacagaatgttctgtctagaaattgcctccaggcaggatttacctatgacagccttggccagtggatggttctatatctttatgcccagttcaaactctggaacactgtcatccctgaatccctccccatctcccaggtccctccctctatggcaggaaaaagatccaacaggcctgacatggaacttgactgctagggtttatagtgatacaggaggcaggagagagaagtagaaaatgcatataaatacatctcatatacaatgtaacttatcttcagttactaaattagcactctttgctctccctaactatatgcacattgatatcactcctcttgcagctcaataggtatgtggtgaacctcttgccataaaattatgctcctgcaaagtgatgggcctgagcacagttgggatggggacagaggaaatctcacaggtccaaagctaagtcctgctccttcagactctcaactgggttcccaagctggcatggatagaaagggcacagtttaccattggtaaaggctttactctttagaatttgccccccacttcaaactcactcttccatgcctgtaaatattcttccatggacttccacttgtcactaaaggaaagattcaactcttgagtcttggtgtacaaatgaggggacctattgcttctttaatgtaccagtctgtcctcaacatggagaccagtttcatctcctttgccttccatcagatgtggatgggagccctgtattctgctgagctaatagaatgcctgtgtccctactggaaggtgacagggaagtatgcatccagcaatctatgggaatatcaaggccacattcccttttttaaaatgaggatggcagtgtgttagaatagaaagagttgacatgaggaacagctgtgaggttatgaattctgatcttggtttggtcccagtcaattacgtggtcttagttcccatttaaatgctgaataagtcaatcctcaggggtaaattctttcaaaatgctcataaattgtgaaatcctagtgttggtggggaccttggatattcctttagtgcaatgactgcaaaatatgactgtgcattggattgcccagggatgcttgctaatatgtcaatagccaggctctagcatagagtatttaggctccagcatgggtattttttttttaacagtcggtcctccttccagtgtttgggaacaatgatctggtttatctgccagctcccaggtagaggaaaatttgcaatgaaatcttcccagcatggctactcttagccagtccttactcccttcccctcattgacaactttcattctgtttctaaggagtagggctcttaccaaaatgtcaatgtgacccacctccagtccactcttttcttcgcagagcgtaagaactagttctgtctggcactcctggaatagtcataggacagagaaaagagaggaaacttttgagttctgataaacacatctgcagcacacatcttgtgagttgctcagtgttctgtatcctcttgtcttttctggtgaggatttgatgatgaagttggagcatggtcttcaagggctgaaatccaagagtttctaagtagagtaacaacatcatgaagtctcttaacatcactatgagataacccgtgtaaagagagatttaataaccatcaaatacttgtggactctcccatgcttccaaggccccttgttgttgagtggattgtgcacagaaataatatatgtccctcctagtccgagtcagtaaaatgcctctacctgcttctccatgctctcccttggcctttcatggtgattgcagaggccatgcattgagattgtagaccacaagatacaatcagcttgaatccctgagtcatctctttaaaggaagctgtgttggagagtcaccagacccaaagtgacttttcctgagtgagaagtaaatgtttaagtgttatgcctttggaattttaggttttagttgttactgcagcataaccttgtctatcctgattaatgcagttggtatcatcctgaagcgtactcccttgtggataaagcttctagttcttggcgtgtttgggttgcttttcctcctaaaaactgaatggaactagaactttctaggaaccctttcaagctgcagtaatgatttactgaagcagaaagaacatggttattttgagtctcagaagaaaaacacaaaacaaaacaaatctaggactgttgtctttccccaagaaaggaattaaaaatagactcatatggacaggggaaaaaaaaaccgacactgcctgatctggtgtggacatgttcttcgaaagtattaattgcacactcatgccatttaaaaatattaatttaaatgcacacagcttgtaaatctcttcttgttctgtctgctggatgacttgggacaaagcaagctgagaattaattgattaataacaagctgtgacctgtgtgtgtggttttactgacaatatcctcaggacttgggcttcttggagccatgcttctgtcagtgggaaaagtgctttcatctttagagaatgttaccactaagcagagttacctaatctgatgctttctcctctgggtatggcagaagtcgcttacttgagaatggatactgatatgttatttttggagctgtatttaggggatttatttggcacatgtggtatatattatagaatggcatgtagggtgaagccacggactccacaaagagccttctgtccattatgatctgttgcatactgaaaatttccactctgagtaatgcatatctttacactaaacatacatcattcccagaagttgtttgattaaatataaacatcttgcctagggaaggcaaaatattaagctgctagagtacatttggaattttcttagaaaggccctgaaagaataggatacaagtcagacatattttgatgggggatgtgaatgagggagatgaaccactgaggacagagtcttgaatgagcagaacattgtagtggaggagccgtcagctcaacagcacagattcctggaggtggacaatgacgtaggttccagggataaaagatttggatttgttcaggacaggccgtgagtgcctgccttggtgtgttataaagatcctatgtggttggtttctttaacattcaacacaggattctcgaatattttagaaatgtgcttgggtttttttctgtaactcctaggctagagttacatcatatcatatttagttcaatgtgtctgctgttctcaagtgtggtggtgctggcaggtaacaacgaggaagaagtgaggcagggctcaaattggggaatacatacctgtgtgcatcctggcccagggagtgggctgaaaggagggcaggagtggactggcctgctcaggctcccacacctgtgtggcaagaagggtttgacccagagaagcagagcaccgagagccacagaagctccctcttccttctttgagtgtgcctagggtctcagcctcagctttggcacccagagccacattccaattaggttcttaggggagtagccccttccttccttgcagagaaacctgcatgaaagtttgggggacttcactttcttcttgaagacatcttatgtccaaattaatgctactatttcctgtgtctccactgttttgacacttacctttttcatgcacttcccagagcatatttcttttgtgccagacactctttccccagaattctttccccagaattcttctccaccattttgtttagaaaaaatatgttgatgagtctcatggagtaaggggtaagacctcaaggaaaatgctccaccatcaaaagatgccataactttccatccacagagtgtagattgtgttacctggagaatcttttgtttggtgagtgcccaccttggtttagtgtgaaagtctgactgtaggtcagagcaaagcagaattgttctgcttcgaagagggcagtatcagtcaagtgaggccatgctctgctacagtaacagacagcccccacagtggcataacacaagaaaggtttatttcttgctcaatacagtatatatcagtcatgaaggtaggaggccagtaggagggtggaggctgttcatcagagtcactcagcaaaccagattgatggaaacttcctcttggtctttgcttccagcaccgtcttggcaggaggcagtggtgaactgctctggctaagagcttccatccagaagtgtcacgcatcatgtggctcatgttacattggctagagcaaaccactcagcactcagccacacttaactttaggaaactagaaagtgcaatcctacaattgcccagaaagaggacgtaataggagtatttgtgaatatccttaatgacatctacaaggggtgaagactgctctagtgaaaaggtgaggcttttggagggcgagtgaaggacttgggcttcttggagccacctttctacctcaaggaactctgtgggaaaaggtcagggaaggaaatccttggttgtgctttggcctggaaggaactaaggcaaactcaaaatctgttagagcatttgccatgagatatgtgatttaaattccttttctgccttacctgtgaaatcttcaacagtctgtgttgttcctttttgcttgtatctggagcaatggcatggggtggtgatggggtgggatgagggacaagagggagaagctcaaaaaagtgtaaccttcaggatgaaagttattcagggcaaaacaagatgctgtatacatgggcctaggcactggagaagccagagacagctgacacctgagttaatgtacctgttatttttcctcctagcttataaattcctcaaggtcaaggatggtttcttatttatatgtatgttctccgcagagcccaaaactactctggcctcagtaggtgctcaattgcttgaggcatgtttgtgggtgaatgaataaacaaatgcacttctgcctccttctcttgtgtgccaaggcttgcagcgggccagcagccaggggaggatgtggggtgggccagcactctctttgctcagaaaagcaacttgcctagttctgcatccaatcttgacttctaagccaaggaacgaagtctccaactgctctcagagtaggatacaaaaaccttcctcaactcttctcacctgtgcttagggacatttggcccttggtgaataggtccaccaagataccaagaggtggacagcagcataggagactaatttcaactgtcctttcacaaatcttctaggacgtgagtagggactgaccatcaattcatttatttatcaaacattgaaagggtgcctaccaggtgcttggttctatgtcaagagctggggctgcacccttctgtaagcttgcctatgagtgcaagctgctttcatactagaaggtaggatgataggtgaaccgccttctacaagtggagacccatggggccctctggttgtgcctccacagtagagtccatggtggtgtgagccgtaacaagcacagtccatggcggcatgagcttcagaatccaacacacatggattccatcactggctatgcatcttgagtctgatcttgagcctcacgtttaacctctctaagcctctattttcaactctgtaaattggcgatcacagtgcttaattgatagcttgttgtgcaaatgaaaagtgaaaatgcaggtaaaatcctaagctcagtcacatagaaagcacttagtgtcagtcaatattgcaatatgatgatgccaatattgttaatgataacctttctaagttggagtgacctcacctaaaaatagtacctccatcactgagcctatggtaattacatgagatagtatgagacacttagcactttctgggtacaaaacaatagtgagtaacatttacccaagactttattttgtaaatgcctctcttccatcactactgcctcacttggggcacctgggagtatccaggttgaagatgcgggctcaacccaggagtcaagcaaacaatttctagtttttgggatgccttaaacaaaaccgtgaatctctaagctcctcaggctggaaatggctcactgctggtggaatcattaagagtgccagccagatctgattgctgcattcagaggtttattaatatcacctcgaatttatcttccccgatgaggaaattttgccagcatctgacaaaaatgaaatgtacagcggccttgtgccaacaagcatcctctccctgccatcggctgttagcagaaagccagtgcagtgggctgctatggggctaataaaaatataagatgaaaatgggcttcgcatcttcaattaggaatttgggcttccaaccctcctcctgaggctcccttccccacaaccaggctatgataataaatttcagaacctcatctccctctgcgagtgtggattctctccccaactaatcctccaatactcatctgagcataacactcccgatgaaaccacacttgtcccttctaaacacttcaatgaattcccttatcttccagtctggaatgtaaccacaaaagaatatcaatgagaggcatgagtggagctggctacaaatgaaacgtgaacaaaatcttggtggagtgcaatagggtttcagcaagaaggatcccaggttgcacttcccaggtggaagtgggttccttagactacattcggtgagtcaggtggtcacctgtggccaagtggaaagacccttcaaggccaaggaaccagacaatgtcttcaaggcagtcttgagttatcctgctggggcctggcagttggcagtctaagtggtagggggtgattgggaaggcactacaggtacgtgacgctgtgtgatagagtcaggagcaaggagctttggaagcttctagcgccaaggcaccttcagtccattatagaatgtccagtgtccccattttatgaatgagggcatgacccagaaagaagtcacttgtccagggtcacacagcaagtcagggtcgcagggctagagctagaatgcatatctggcttctctgaccagcagtctttcccccagaccatatccctactttcctttatgtggttaactttaattaagctctttctacctaccaagcacacccctaagcagtgggtgtcctcctttgaccttcataacaatctcgtgagaaagatcctcttggtgctttggtttgacacttgcatcttggggatgggaaagtttaaatgacttgcctaaaattattggctgaggtggtgggttcagggttccagcatagatagccagctctagagccttgcttgtaataagcaggctaaaccaatgcttctcaaagtggggtgcctggaggagcagcgttacctggatcttagaggtgcagattcctgaatcagaaactctgagggtgaagccaaccctctgtgcttgaacaatccctccaggagagtcccgtgcaggctcaagctcaagtttgagttggtctaaactacttaagctggtaaatcttctgtattttacaacgagtcttccttttcatgctttgtaaaccaaattgctgacttcccaaacctgaggacatttccaaggtcatcgttacctctcagcagcccattttcaggtggcctcttttaactgtgggattctttaggaagactgagattggcacaggttccctgctgcccagcagggctcctgagcttgaagacagcaaaattggtgttgttgaaccttctgttggccagaggggattttgagagtcctgtctgctatcacgtggacttggaaaatttggtccagtcaagtggaaaattaataaaccagaaaggaaagggacacagtattcaagacactaaatgctcattgcaaccagggagcctccaggtttctaagcattgctcttctgaatcccacactggagatattttcctcttaattcaatagatgtttatcttgcgcccaccaatgctgagtactttgcttagcactgggaatataaagatgaagggatgtggtccctgcccacagagaacccacagtctagaatgattatgtggtgatgggatcctccactggggaaaatgcagtggcttttacttgatgcagtttatgatgtttggttaatagaatgtcacataaaaacaaatcccctgattatcccactgccaatgggtggcactgcattctaataaaggcagcacttctttggtggtgtgggggaaaagaattgcagcccagtgcaggagagcctgatgaagactttattatttaatgaaccatgtcatatgaacagctgtggtgtaaaccagccaggacaattatgcaagttggattatgtctccagtaaattgatgctactttatttgattaggttggttctccaaagacaaattcttccaagttgggttgggggaaaaaaatcaccattctaactttgcttctgactttcaatcttcagattgcttttgctttctaatcctaagaggaaacaaacacaagatggcagctatgttgttatcatcaacagaaccgagaataatcacgtatctgtaatagttatcagcatgctctgtacgagactcacactgtcttttctcaatgagcttgcctggggggcaataagagacaggcaggaaactgtgaccattcctttgtgagtccccaaaacagcctggctgcagctcactaagccattgtcttcctttacacacaaccaaacgtaggcacatggctaaataaacataatgaaaagaaatgggcttggtgtgaaattcttcccagatgcccttccctgccttttcagattattaggtactatctagttcagtgtcactgtgggtcatggtccatcagtagcttgtgaaatctatttaatgggtcatcaccaacatcataagaaatgaagcagaatagaataaaacatcatagtacatcccattatatatagtaaaggtaaacattgcttcgtgtgtgtgtgtgtgtgtgtgtgtgtgtgtgtgtgtgtgtgtgttgggggtgtggtggtgtcttctgaaccatgttgtaaagtacatttcttcctgagggttgtggtcaaaaacatttgaaaaatactattagttcaagctgtttattcacagacgagagggcagggatgatgaaattaccctgctaggtggatgcaggcttttgaacagataatgtgagagcttttaggaagagagttggtgagcaccaggagctaacatgggttcacctcagccatcacccagacaagcttcagaccagactcaaatgtgatggtcttcatgccacacaccaggggtcatgaatgggctggaacttacataaacacaatcaagatggataacgagcaggtacaaagcaacatcttaggagcaattgttaggataactagaactattcctgctcttctccaagccattcagcaggggcgcaattgacattctaaaatctttgaatgtttgtcatgtggaaaatggaatcgatctcatctctatggccccagcacttagatgggtgttttgatctaggaaacattttctttttctttctataacatctctgatttgccctaattcctgcagccagacagtctgtaagtgaaacaggctgcttctggatgaaattcatttcctgtaacaagaggggatcaaaaaggaaaattatttgtccctgatgtggcctctgagggcagtgaaaatcactggatgaatggttagattcatcagtggcttttggccttaagacactgtacacccaatagacacacactcatgccctgcaagtacaagcctaattttcctgtactcacctttactacatgtgatgtactttgatagtttctattctggaatattctattatttcctgctagttccatctcattccatcccactccactccacttcatttcattccattctcatttcatttataaaatgacggtcaggactcatgaaactgatctcatggtccactaataggttgcaacctgtgattttaaaaataccagattgggttatattcaaattccctttaacccccaaatcctgtgagtccaatgtaaattgctactacagtattagggtacaaaattctgtgcacagcaggctcacagataaagtttttgacaaactgaaaaccatgtgttattaattcacttactcattgattcacttcctcatccatcccgttcattacttaccatgtgccaggtactgtgctaggccacattgatataaggtaaataagacacagcccctgttctcaaagagctcttggttacagggacactgattaggtttcctggggttgccaggatcctagcatctgctttccctgagtttccttggaaggaaggtcccatgcatgacacatcctgttcgctgttcttgggtgacgtatgtagccctaaagtcttggcccagtagcagagaatttcacatccttcagtaaataaaaaccaaagtcaaaatgaacatatgctagaaaacagagactggcagtgctgtgaaggccctgtcccctcatggactctgtcgtgagtggcttaaggggaagagaagtgctcctcttaccggcatcaggagccctaattactgttgtatattgattcctttcttccgcagaccgctaatcctgcagagcaacttgcagggcataataattgggattgcccaatgctgggagctaatcagatttcttatgtgtagaccagctttatgctagcgtttaaggaagctcctgattcaagcacagaaatgaactgtttaaccatttccgagccagagatgagccatcacagaccaacgcggagtctgataggttaggggtgaattgcgctggagaggctgaacgtttcttaaagtccactggcaacaggaagtcctcagaagtccaatttgttgttgttcctccctgaacttctggatttctgaggatggttgtgagagtggccgtgtgtcaatttttaaatcatgtggtaatttgtccatgattgtttattttgtcccccagcaagattgtatactccagaaaaggggtagctgacctactaggtgaaatcatgctgtagttctgagttgctgcttcttcatgcatacaatggaaacaagtacacccccaccaggctcatgtggagggctcagtgactaacctggccctcagctatcccctgctactcccataaaagctagcactgggcatgtggcttgtacttccaacaatgagtactcccttttctcccctaaatccagccctggaagcattgccgtgtttttatgcctcttggcattctttattttttgagacagaatctcgctctgttgcccagactggagtgcagtgtcacgatttcagctcactacaatctccgtctcccaagttcaagcagtcctcctctctcagcctcccaagtagctgggattacaaatgtgcatcaccattcccagttattttttgtatctttagtagagatggggtttcaccatgttggccaggctggtctcgaactcctgacctcaggtgatccgcctgccttggcctcccaaagtgctgggattacgggcatgagccaccgcggccggccatctcctggaattctttgtccacttttctgtccttcctctcttcccttctctcatgctacactcctctttccacttttggtcaatcagccaaaattacaagtacttttccaaaccttggggtattggagtccatggctcctggctgctgtgcatggtttccccttttcctgggaagcttctgtcccactccctgcccctcacctcaccctagcactcttcataccaaacaaaatgacctttctgggtgttctccctggagttccttcgcttgcgcagtcatagcaggctagcgcctagtgggctgtgtgcatctgaattgcaggttgaatccaacaacatcagtgaggtgggaggcaagtggctgggtgcggtgccatgacattctggctcacctgtcatgttggatggcttgtgtgagccccaggaaacccgtgcacccttaggaaagcatgggatagatctcctgagatgatttcagagaaatgacagcagaccattgtgagggaggcagcatgactgggggaatggataaggcttaggtccctgagaggcagatccactccagccttgcggaatgtcatgctcctgcagagggctgcaagaagaggtgaacccattcccaatcactggccaggttagacaaatcattggattctgggacatcagagctgaaatagctttattggatcatctctggcccagctcgcttgctctctctctcaatctcttgatcttttttatttatttatttttttaaatgataaaaacaaagttcagagctggggcataacttgtccaaggtcactgagagctgtaaccatcaacatgtggggcagcagctgcctgggtttcaaagaaaggggacttgctgccattcctcctccccctagttgccactgtcttctcatgggtttccttgtccttccctggtgccgagaagcagggaggagggagcatctgttgccatggaaacaagcctatagtatgagttcgctctccccaactggctgtggtttctctgacaggggctgctactggtcctgctgttgggccctaatggggactcagggaccaccactgtatttgccaggggagaaagctggaggagcagcagacatcccctaacatgagttgtgcaggcttggtaatgtggagtgggcatgcattgtggtgattcttcttgcttttttaaaccaatttctcctctgctggagactcttcacagaatttaagagtctttctcagaaggtgatcagccttggacagactttggtcttcagaccccagagccaaacttttgaactgacagcagctgtggccaaaaatggtgtttgtcagacctgcaggaagaaaatctgcaatgaagagttggagtggtaggaaaagaggaaaaagagggaacttgttttgccttcagacatatttaagtctcctaagtacttcaggagttaaaatggggctttgaaaataaatagacttttctgttcatgtggggctgaagtgttccagggttggaaagggttttattaggtcatttcatctctccctctgtctctgggcctattctaacccctcttacttataaaaatcgcagaagagggtgatttcataagctgccacgacaacttgttccgctaacaattcatgatcttaaaacaatctccatagcagggagaaattcctcctatttcctccaaagctcgtctgtctgcgggccaaggctgctcagaggcagctggggttttaagaagtgagctctggacttggatttaatggtctttgttcaaatactgttattgcatccttgaacaagtcacataactgctccaagcctcagttccttaatctgaagaggttagtgtgaaggggagaaaaagtaacatatgttaatgtgcctaagatggtatctggcacacaggaatgcttgttagatgtgtggtgtggctttgggctgactaggatcaccatggtatgggcaccttttggatcgagatctcagaaattaaccctttggttgttggatcatggggttgggatgggggataggcactgcagcagcaggggcagctgagggggcactcctaagtcaaggccattggctgtttaccagccggtacaaaaggtttcaatatttgagagactggtttagttgtactagtgcacgctgtctaaattatcatccctagtggttccttcaaagacgctaagcacattcctgactccacttctttgtttatgccactcatgtccccccatgccttcaatgcctttacaaatcctcccaacccatgaaaatccaactcaaattctgcctcatacatgatgcaattcagcaccaaacccataaatctcatgccccacaagctttatccaggctggaagagagaagaggagaggttgtttctgtgtggctgattgagctgttggctgactcaagcaatcacagagcctcaggtatcattcaacctgcaaattatagatgaggaactgagaccagagaggctgtgggactcatcccaggccatcttagtcatcaacaacaggtctagagccttggtctcctgactctctgcctatacttcttgtccatgactgaggctgttccttgagcctggaatgagaacagagtcgtcccccaccctaccagcactcctcctacccagcacttgcttgctgagtcacacggagggaggtgggtagggggaaaatatatatttgcctggagaacacaccagtctggaaaagtgaagccagccaggttcagtgtgggtggagtctcccaccagggatcccaccctagcactaaccagggttgaggtgctggggaaaatgaaaagcattggtgtctttctgacccacctaggtgagtgaccaactttaagccatgtgtcacaacgtggcggttttactgtttattagaaccttgcttggcttagcttttgtagaacttggcttttaaatagaaattccttatactaacttgttctgctgtcagggagatgctggccagcctcgaagcacctggtatatagagacatctggagagcgtacttcaggctgggaggctttgaagtagatggttgtgggctcgtgtgtacatgtatgtctatgatcccctttgctggctgcaaattctgtcatcacatcatggaaaaattcttcttaaggaaagttgcaggtgcaaagatgctgatgttggatcaaccgaggaaatacagttttggtcacaaaagtggtatttatgcactctgccggcacgtggttggcccagatggcgaaaatactgttgagatggccgggctcctttgggtaagggaaatacagggctttaagagcagtagggaacagtgaaggatagagaagcttgatgctttggagctcacaggatcagagttcaaatcctgacttggcggccattttagctgtgtggccttaagcaattctccagcaccttgagcatgctttatgggtaggggctcagtgttaatttgggattctttctcatgaggatctcaaagataactgtagctgggtatctcaggggaatatggcccacagttttgagtcctccagcctcagacatcagagtagactcagggcaggtaatgtatgtgtgatggtggacacacattatctgcatggcggtggagaaacctgcacatgagtgatccctcatgctgccattttggtcatgtctcagtgttaggaaacttacagctgctttgcttcatttcctgacaaggcggcagctggaattgtcgactttgctgttatctggaacagctgctgggatttaatagtgcacttagaggaattacctggaatcacagcaggcattatgaaatgggaatgcatttctgtaagcccatctaatgtttgagggcaagagagcaggggctttccctccatagtgagtgagacataaaagggactggtttgtctgggatgttgccctcaagatgagcaatcatttcatctgggctatgctcagcatggcactcagcttgggcagtgtgtgaacttcagtgacaaggtctgcttaggggacctattttcagatcaattgctcaagaaagccaccatctctgggcacctggggagtgacagccatcttggctaggactcaagggcaactctagatagttcagtgctgagcctgtcctcccactcactcctctctgttggtctggcatcaccagactggcattttcctctcttctgggcccagtcaattcacttctttctctgatatttagtaggtgctcatctacagcaccttgtcgctgggtatgctgtgcttatcttaaggtggcttaaagtctttttggaaaacaggttaatgaacatgcaattattagacaacaatggcagcctaagttgtgattccaaattgaatctaagcaaggtagaatgagatgcttctcaacgtacaatggtgttacatcctgatagcccatcataagttgaaaatatcataagttaaaaatgtgtttaggccgggtgcagtggctcatgcctgtaatcccagccctttgggaggccgaggagggtggatcacgaggtcaggagatcgagaccatcctggctaacacggtgaaaccccgtctctactaaaaaaatacaaaaaaattagctgggcgtggtggtgcgcgcctgtagtcccagctacttgggaggctgaggcaggagaatggcctgaacctgggaggtggagcttgcagtgagccaagatcgcgccactgcactccagcctgggtgacggaacgagactccatctactgaacatcatggcttagcctagccttaaaccttaaatgtgctcagaacacttacattagctcatagttgggcaaaattatctaacccaacacctattttgtgataagcgttgaacattgcatgtaatttattgaatattgcacttaaagtaggaaacaaaatggtcgtatgggtacttgaagtacagcttcttctgaatacccattgcttttggagtattgtaaactcaaaaaatcataagttgagccattgtaagttggggactgtgtctgcatgtacagggatgatataaatgcccttggagcttggaagagggagaaatttctgaaggccagaagagactggctttggatgagctatgtaaaaccaaaacccttgtagccttgttgggattcagggagccatgccccttctgctgatcttgcaattgatgacctttgaactgaggcagtagtagagcttgggttaaattaaaggaaagggattctacctcatgtgttcttttgcaagttgagagtgtcaactggtctggggatgacttgagctgcgtgtgctatgttgcactggtgaggtggtcacttgacctcgtaccaatactggcttctgagtggcttccaggtattgaccttggctaatgagattggattcaaagcatttgcaagtgccagtaggtcagtgatcaccattatctactgtgcacctcctaaatgccctgccctttttgcgtaagctgggtctgacagccctaatcggtcctacctcctagatagcactgtggcccatttattcttacctagttcaggccaccatcacttcttgtgtagacaactgcaatagtgtcctacaaatctgctgacattccctcctaaacaccccctctctgtcaaatccattcttctaactgcggctggtagaatctttctaagatggttttctgatcatgttaattcttttcttaaaactcttcatttatttctattgcacttggaagaaaacctaatcttattatatcctatatgtgttgtctgacccagaatttttgtcattctttatttgatactcatgtggctcaactgcaacagcagcaaacagctgggctctacccatgtggatccctctacttggaatgtctctcctcttctccctttccccaccttttgcttagcctccacttactcatccttcttgggcatcacccctaccagatcaggttagctgctcctgttccacagctcatagcttgctgtactttccctttgcattccctaatgaacccccatgtgttatccatgtagttttctgtttagtgtctgtctcctctttccctttcagggacccttgcaaggtccctgagggcagagaccacccccattttgttggctactgctcaagacctagcacagaagcctgcagctcagcaggctctcagggcatgtttgtagaggcagtggctgctttggggtttccagagcttccttgggaggtttcttctgtgtgtcccattgaccagagcaccactgggggtgaagtgagccccagacatctttaggtttccatctttaggtgagctttatgcccaggcacgtagcagaagaaactgtttctactcataaaccaagcaaatttatagtggaaatcagtgggagaaaataaatatgaatccccatgatgtcattttatgggctgctttatagattgtaatcacccatttagagtttgcaggctattaattttgtttgcgcagagcctcaggactcttggggacagaatttacagggctgtggtgtcagacacgtggttctaggtcttaaacccctgaaaggttttggaaagagaatgacaggtagcctatggagcagctggggcttagggctctttcctctagctttcctcctggacatagttttaaaatatttgttcactgttttatcatcttaattttaccctagtcttcaggcctgtcctttccgtaagctaggtgactatgtgggtcttgcattaaacctttggtagagagagctcccctctgagaacctgaagagatgtaaagaggaacagcacaaggtcagagagaactgggtagaatccagctctactccttggcttgtgatctagagccaattttcattgttgttgttacttttttcaaccttcgtttctttctctataagttgagacccatgccctcaacctcaaagggtgattataaagataaagaagaggaaataggaaaagcatttggtactcaaaatgagttatagttcataaaatgactatgacgattgctgttttaaggtaagctgatagagtgggaacacagtggaaactaggagtcagggcacctggtcccaaccctgtcactgatgtgctgggtgattttggacatactagttagcctctctggtcccaaattcttcattggtgaaataaaatgtttggctcaaaagattttcagacatggtgcttctcagtgtggtccatcgaccaccatcccctggagacttgttagaaatgtagattctcaggttcagccccagctctcttggcccagcagtcaaaattttaacaagctctccaggtctctggtgggcatagtgaagtctgggaagcattaccttggttctagcactcatgtccgatattgacttcccaagcagcagtcacctctggagccttcctctttggggtcttggaccgcaatggcctttggcaaggagtctctgctggatctgtgctgcacacggggtgtgggaatctctgggcaaccagaagagcagtagtaacatctttaggtaactgaagtcaatcctgcccactgggcaaatattaattggttgctcagggctgcactgagttcaaatactgagccactcaggggcttcgaacgaccaagatcaggcagttttcaacctgtgatccacttttggtagatttaaggcaaaagcaaatattttttgccattttttcccaaattattttaccattatggcacgtgttgctcctgcctaggagatgcattccccagaaccaagcaaacaagaagaaggtcctccttcagtgggctgtcatcgatcattccccgttccatggccacaggactgactgctgatgaaatctaaaagaccagcttgcagaaggcatggaaatcctggggttaggggcccctctgctatggaggtatgactcacagtgggtcagggaacctgagtgggatcatccctggaactcagaatctctaagacacacttattggctctctataagcaataacagatggcaagataatattattcttctaatcttttgctaaaaacattcagtcatttctcaggggcctccctagtagaggaagacacctgcagggtatctcattctttcttgttctcattttcccttctaccattttccccttagtatatttctggccctatgtgcaggaaatcaggtagctgaggtgtggtttaagggacccattgtggttcttatggcccatcaacacaattccttcgtgttggcctgcagtatccatgtttgttacccttttgggtcaaggcatgaaaacatctgtccacaatgccagtcttacctctgatatcaaagatagtatctgagacgggtgataaacaaatttaatgtgaaaagctgatgatgttttgaagtcagtagaggacggagctgacaatgagcgtcttgcaatgagtctgttctcaatttcattgctgataaagagaaacagtgtagtgtggtggcgaagagcacagaccctgaagcaagaatccatgggctcaaattctgagtctttaagtctgtggcccaagaattcacatttctaactgacttcctgggtatgctgatgctgctggtctgcaggtcacactcagggtggcaaggtcaggcaaggtcagagcacagcatgggagggactgtgctgcctgtagtacacagtggaaggtggaggaagcccaggggtgacatggcttacttatatcatctatgagttttttgtttcctttaggaaatttactgaaacattcttcattgcaaagtataaaaacaaatataaaatattcaatgggtattagaaaatcaggtatactctgtttacctatgggtttttctagaatggggttaagggtgggaaagtgatgggagacttaagtagtagaagtctatcagaggccccttcagattaggaaatgccctcaatgggcttcagtatcctttatgagataatgcataagtgagtggaccctgaggagaggagagaagaacaagaccttcccctaaggactatacaagacatgtacccatggaaagatggatgccatgatacagtgaccctgtgagacagtactggtggagtcaatatgaataatgggagaaggaacattcacttctgtccactcttctaaatgccatcgtaaatgagctcatttagtgttcagagcagagtaggtattattatttccacctcaaacatggagaaactgaggccagagaggttagtaattttcccaaggctacacagctggcaagtggtagaatggggatttgaactcagtgatacagcaggaggtagacaaatccctaggcaaacacaggtgagtccccagtgaaacccccccctgcaaaccaaagccagtttaaagtctgaaagccaagctacaagtcttggataaatccacagactggattgagaacctctcttcccatttggcatgctttcctctgattaacccccacctcttcacctatacccacccttccccaattggtttttacactgttgcctttttttgcatactcacagaccaatcagtatccaccccctttctgagcccataaaaaccctggactcagccacactgggacacagagactacctgactttgggtggtagacaattctcacgtcccctctctgctgacagctgtttcatcagttaataaaacttttcaccttgctcacccactggctggcagcataacctcattctttttgaatgtgggacaagaaattgggaccctggagaatgtgggggctgaacaaacagtcatggtagctgtgagatctgcaccggagtagtcagggtgtctcctacagtgggcctggacccgagcaatgcttgtagggggaattggcagctgcaagtctgtggcccacagagtgaccaagaaaaactgcatcatcaggactggccacaggacaccattaattaagtgcttaaggagcagtatgggggtgggcagcaacccagggatgcaaaaaagagaggattctcaaccaatagctcctggagctcagagaagcagcccctttcccaggtctggatccatggattgggagcaagttactccaccatttggtggaaggaagcttggaaatcagagggaccagggctaagtcctaggtctgctgtttactatctttgtgaccttatgcgagcctgattctaatctctgtctccccacttactgtgagaaggaagttaaaggagatggcatgtgtaaagggcccatccaacatgtaggacatggcgcacccctaatatttggcagcttgtctccactttgcccattcctactcccaagccttggagtctgagatgagaggtcactccacctggctttagttgggtttgttttgagtccccataggctctctgggactctgctttctgatgggttgaaaacattaggctgttgtgagatgcttccattactgtgatctaaaagcatctaggatgcctagcgtagctttctcactggattgccaatttctcagagaattaaacatttagtgcccaatcagatatttttctatctgcatacatgtggaaatgtatgcttacccacctccggggcgtcaattgaagtgcagttgaagccaactcactaattctccagtgcatggtagaatcttcgtggttggtgaaatgagtcatgtgtatgatttgatggactgtatctatgaaagtagaagatggagaggaaacaaggtctgccataaagaaaagagcttggtatggatgcaagaggaaaaagaagggggaaatataatccttcaaaagtccatcaagtttacctagaaacagatttacttaaaagttttgagaaatttatttctgatgatgatccttatgagtcactatttcttatggaatcaagccagcataaaagttatcttgcattctcagcatagctagtttagagaattaggtcatttgtaagtcaaaagatttctacaaagttcaaaataaataaattccaggtatctgagcttaagatggctgggaagaaggactccatttgaggcaggttttctcatttcccagcttagaattgccttcaaggtctttttctttatctcagaacaacaaagacactgcctgaggaagaacctctgctttattatggtgttctgcaacctaagtcagtgaagttttgattctcctggaagaggctggccagctactcattagctgcagggattgaggggatttcaggcatcagatggaggtggggacagactggagccagagttcttgattccactgcatgttacaaccatctggggagcttttaaaaatgctgatgcccgggcctcacttccattaatggaatcagaacctgtggggccagcgagtgccctaggatttctgtgagcagctcgggctcagaaccacttgttggatgctccctaaggatctggcaaggattttatgagtttaggtttgagagcacctgaaggagtccagaggggctggagaagaaaggagatggtggcttggtaggcacctacatccccaggggtgctggtagagactatgctgcaaaattacccaggaagaagtgagtctttaacattgcagccattactatgcatgaaatggtaattaaaagaccatattttcttaactcaaatacgttgatgagaaagatgcaccattgatttaatacctgctgttttggaggatgcggtgggagaaaactctattaagtatgtattaacatatggactgattataagatctcagtttcacaaatcattttatgttggaaaatgtgcttcttgaaactgatctaacaacataatgatagagtgccttatatggattactctgcctagtcctcacaacaactctacctgtgagatagatgctaacatcctccccattgtatgggggagggagttgaggcacagattgaatagcttattcaaagtcacaggtagtccagagctggtcagtgatgggactggaattcaaagtgtggttttcagaagtagcccacaaaatgtagtgagatccaaggctgttgctttctcaggtctcttaccttccccagagccagggaggtggctttcccttaatcagggtaccgaatctcccaagtgcaggggcgtcctgtccactggctctcatgccctgcacagggtacctggcttaggaagtgaatgggaatgaaatctggcttgaagtcccttagcaggccctgaggccaagggattattttttctaatgccacagaggctcagcatgagctgatggagcccagcccagggagagaagccacactgactgggctgaacagtggacacagcctccctaccacgcctggtggttctttcacctttctgagcacagcatgttagagaatcactctattgggtttgtctgatgatacgggaccagggagaaggaattggagagccttgtagctctggggaccttgatgctatgcctttaggacaaaagcccctacttcccatgccagtttgccccaacagcatggcagaaatggaaaaggggagtgtaggctgaacaggacctttggaaaacaccaggttctgatttccagaccctcggtcttcttgtgcaggctttccccctctttgtttttcccttttctcaaattccttgacgtggtggcaagctgaacctcttagagctgcgttccagaacaacctgggtaatggaaagtacaaaaacaacttaaacttgtttccaaagcttgataggttacaccgacttctcagaaagtgtccatttggacccaaaatgtgaaataacattttgaggcacgttggaggggggccagagggttacgcagctgcaggcgtgggccagatgggaaatccagatgctggcctagggagcaaggtcccttctgctgctcatgcaggctgtcaaagcagcagcctccttaggaccctcactgcaagctttaaaatgttactccttagggagaatttcagatgggagggaaggcttaatcaatacatgcaacgtttaactggcattagaatgatgttttgttttgtttcttttaatgggagatgatgggtggtagtagtaagtcagggagggcgttgcagggtgtggtcttcaactttccccatctttatcacatgccaaaagttgctccatttcagcatgcaaatctaaatttaaatagtcttctggcttttaagaaagccccctagctcacctgtgcagtacgactgaactactatgaaaccagcactggtgaacatatatgtgtggaaacacaacaacaacaaaatcagttgttcaaaagacatatttattattccttcagcagagaggcccatctgatgctctggggcgcaggtcccatgaatgttcagggcagtctctgcccaggccagctccttccccgattgtccacagtgatgatctcttacagactgtcctgcctgccctgcacacaatgggagccagtctggaggaaggtttggtggccatcactctggcgggcactggaaagaactctgctggatgccgagggccatttctctctggacttgctggtgttcagtgtggaagtgggagggaaatcaaatgaggggacctttgggaggtcacctaatgtggtaggacctaaactcagctgggtattggaatcatctggagatttttttttcagttagggtgccccctcctgccttatcaccatagatctgcagtgcagcccagacatccatttaaaataagctgcaagtttgggcacggtggctcacacctgtaatcccagcactttgggaggccaagttgggtggatcacctgaggtcaggagttcgagacgagcctggccaacatgacgaaaccctgtctctgctaaaagtacaaagattagctgagcgtggtggtgaatgcctgtagcccagctactcgggacgctgaggcaggagaatcgcttgagcccaggaggtggaggttgcagtgagccgagatcacaccactgcactccagcctgggcgttgagagtgaacctctgtctcaaaataaataaataaataaaataagctccccaggtatttctgaaggttcaggtagcctttctcattagcccgttccccaggattcttctctcagtcctttttgttgacaagctctctctggtttagcaggggacacaaggttcaattattgttccattcttacgatacaattcttggatctggtttggatataaatgtctaggttgccagtttcttgacaacttcaagggccttgaagttgactggtgaggaaaaggcaaagtaaatgcctgagggatggataccaattgctgtccccaggtttagtcagcaacttttgctgttgctcctgggtctactgtgtgcactcctttgagggccagttatcacacaggtctccctttgggtctccatcttggaatccaggcaggagaaattaaccaggaaattaaagacatcttcccttctccactcctgtcatgtttagatcttgggagtaaggagaggaatgggagagcaaacatagcttggctggagaaggaggtggttttgatcttttcttctccccttcctttcataggtagaggtcgtctcctttataccagctgtcttggggagtagtcacattaattatgcgtgtatttagagctttacaagccttgccaccagacgtgtgtagtgccttacagtttaccaaataggttcacatactaatctcttttgacttagtgagatgatgactcagctggttataaatcatcaaagcagcaccatggaccatgcatgacaaccatggagctagggcaaagctgttacttgaatgaaggaaaatgataaaagcttatgttccctgagccgcaaaagaaaatagccgtaaaatttccattgaggctttttctgttatatctttagctctttaaaaatctcatattgaagatacctaagaagtttggcaacaatgtcctgtagatgaaatgtgggtggagccaattgattgggcttcaagttgcataatgttgggtatggtgaggctatttggtttggctctactcttgggacaagagacagtgggaatgtgtccttgttttgtagttctctggaagccagaggaaggttatgattataaatttaatctctcagttttctctgtgtctcagccttcttcacagggggtaggacctccgtcctcacaagttacgggggtggtctcagcttctggagcaatgaggcaagtctgcaccctgttggatgtcttgggtacaaccagattaatgattcaaaggctgggggaagtccaggctcacaaacggctttcccaaagctccagaaggaactttgttcttctctacattcccccaccgcccccccgcccacacacccaggcattcctcttagattttataatctctttggagcagatcggcaggtaggacctctcatctgtttttttcataccgccatgtcatcagcttgataaatgagacagacacatgctagagtggagatagcattctgtgaagagcatagtgatgaggccagatggctgccaagctcaccccagtgtgggtctgggatggcagttctatccaggagactgctaccatcagaccaactaagggagatgtttttcatacatcagctttcattggaactgatagtgttatggaaaatctgtcctgtccccagcagaatgatcaatcaagggtgatgagcctccacttgggtaagcatggctgatggtcccccttctgacacatgaattagttggttttaaaaggtttacctccatattagttccctgttgctgctgtaacaaattaccacaaacttagtggctgcaacaatataaatttattgtcttacagatttggggggtcagaatcccaaatcatctcactgggctaaagtcaaagtgtcagcaggactggaggctggctctgggaagactctgcttcctttccttttctagcctctagagactgcctacactttttggtccatggccccttcctcacatcacttcttacttttgcttctgttggcacatcttcttctctgattctgaccctctacctcccttttataaagacctagtgattacagtgggcccacctggataatcaaggacaatctccccatttcaagatccttaacttaatcacaccagcaaaccccttttgccatgtaaggtcacatattcatgggttcttgggattaagatactggcatctttgagggtcattattttatctaccacaacttccagtcagtgatttctcggtttatttaccagagcctcagggagcactgcattttgcccttttacaaaattacttttaaagagattatgtacttgtaaaaataaaaaaaagttaatttgtttgaaatcatatactttaaaatatctcttcatccccagtttctaatgccccatttttccttcccagagctgaaaactgttttttttttttttttttttttttttttttgagacggagtctcgctctgtcgcccaggccggactgtggactgcagtggcgcaatctcggctcactgcaagctccgcctcccgggttcacgccattctcctgcctcagcctcccgagtagctgggactacaggcgcccgccaccgcgcccggctaattttttgtatttttagtagagacggggtttcaccttgttagccagaatggtctcgatctcctgacctcatgatccacccgcctcggcctcccaaagtgctgggattacaggcgtgagccaccgcgcccggcctgaaaactgtttattaacaatctctagtgtacactttcagtgagaatctatgcacatacaagcgtatgtgcacacatatatgcgtgtctatgtataattttcccatttaaaaaatgatggtgcactttcacactactctcttttttttttttgagaccgagtttcactcttgttgtccaggctagagtgcagtggcatgatctcggctcactgcaacctctgcctccgggattcaagtgattctcctgcttcagcctctggagtagctgggattataggcatgcaccaccttgctggctaatttttgtatttttagtagagacagggtttcaccatgttggccaggctggtcttgaactcctgtcctcaggtgatctgcccaccttggcttcccaaagtgctgggattacagtcctgagccaccacacccggcctcacactatttcttaatgatctattcacatcagacctatatacctgcctttaaaaacagctacaacatatttttactttgcattggtgtatccaaatatatgtaattgggagccccttatcaatagattgtttcttttcttttttttgagacagagtcttgctctgttgtccaggctggagtgcagtggcacaatctcggctgactgcaacctccacctcctgggttcaagagattctcctgcttcagcctcccaagtagaggggattacaggcgtgtggcaccaggcctggctagtttttgtatttttagtagagacaaggtttcaccatgttggcaagcctggcctcgaactcctgacctcagatgacccgcccacctcagccttccaaagtgctgggattacaggcgtgagtcactgtgcctggccctgattgtaacattgtttctaatcttgtgctgtaataaacaatgtaacagcaaatgcattcttacattggtctttgcacacatgtgccagtgtatctatggggtaaactcctatgaatggcatttttgggtcccaggttatgtgcaccttaaataatgatagttgttgctgcattgccttccaagatgtatatatgaacatatgcttagagaccatggcacctgggcctggtcaaacaccatgctcagcagggctctgccatgttattcactaatagctctggggacatctcattatagttctgcctctgacaaggtccaccctccaggaaatagctcactagttgggggttaagtcaaggatgataagtacacccattgggtgagccactgcaaacctgggcccagagttgaagccaggacaaacatgttcactagtaaggctattcattaaacatcatattccaagctattctgtcaaattctagggacacagcactatgtcttcttgaaaacctctgatttcttttgtctgtccacgttgctggagctagacagtgtcgagactttgatttgagtaccgcagtggcgggctattctgggaggaacagacctgaaagaggcagcacatttagcagagactgcagccacaccggctggggccagggtgcttggatgtgacacagctattgtttgtgaaagagatttgatgcttcattagagaaaaactgtgtacagaaacccggcagagatttcttaatggcattctgattaaaggagcaaacaacctaaatgccagattagtcgcattttgggaaagaatgcatgatggggactgcatttctatttccttctttccctcagccttgcttggcagcatacatttgtcactttgaggacatgagaaaggggctctctgatgtagcagagaaagagctggaaagcagaggcatggaaactttcagctttctggcaggccaaggggcaggttggaggttctgatacagtgtctgcaactcccagggtccagagataaaagtctagacggtccagtggatcaccttggaatgcaaggctatgtggatgtgcatcagtcctttcaccaggaaccttccagaatggttaagaaaggaacccacaattcccctgagagtcagggctgtcatgcacatgaatggttacctcttctgtaccatggcctcagaacatggtagagctgatatcaagggaaccaccgtttctccctcagaaccatgctttaggagctatggttgtcccccccattcttgttgtgcaaactcattaggaggggtagctctctcttagaccttcaagatggggatatgcctggacagggtgaggcattaagggtctctctttataaacaatgaggaaaattccctatacattggccaaagtgatctttttaaatgtaaatgaaatcaattgtaagttccaaactccttcccatggcattggcccctgacacatcccccattgctcagatgcattggccacattggcttctggaggctcttgaagcacaccaagctagttcttcctgggagacctttgacctactgttccctctgcctgccatgctcttctcctggcctttcaaaggtagatccattgcgttcttcagatctcagcagagatatccccttaccagctgatatagctctccacccccaaatcctgccacctcgatgctaatttccttcataatcctaacatgatcaggaactgttcttattcatgtatttgaatgcttacttgcttattgtattcctgcccactggaatgtaagttctaagagggcagggatctggttagtcagattcaatgcttgtagaggtcagaacccagccaggaaaacaaagtggctcaagagagtatatttaatgtagggaactattaccctagcatcagaagagtggaatggctaagtaggtcactgtagggcaacccggaggttgacaagagaaaggagctggggcctggaaggacaaaaagaggaggtggtatcatggaggagacctaatcatggctgaagaacagacaggagagggacaggttccaacttctcccttccttccgccctctgggctttgcccagtgcttccactggccaaatccagtatgatccagttggcaacagtgccagaaaacatagtgggggccgcccctgtgattaagaatagagcaggcaataggtggggaattcatctgaaaacactgaaatgactggtgccttgctctatctccagctgtcttgacacatactaggtcctcagcaagcaattgttggatggatgaattaatggaacgcaccactccaaaggagtcagctttcaggtcaactctaatggagtggatccctaagagggaagggctttgcaggctgggtttaacagtggagacttcctgaggcccggcggggtctcagccggctgtgccttctatctctgctgccctgcccagaggaggatgaaggattcttatctctggaaataaccctctttcatgagccctttaatctgagcctgctgacacttttatatgtgcagggttatgttacttgaggaattcctttgaagacaattttaaactttcatcccttagttcaattttaaagtttgtaacatttgggacccttctcagagccctggatttactcctggcatcaagatgttcagggcagagctgagctggaggggaattccgcattcctagtgatccttaactggtgcccctggggaatttatctaacatactggagcctccactggtctgtaaggcagaattaagaacaccttgaaagaacatgaaaaaatgaaataaacagcccaagtaaagcaccagcacatatgaggcacttgaaaatgttcactccttttcccccagacgctgggaaatagttcagatgccccctatcccaggacccatgaagcagctcaccgcagcctctctatgttgatttttagatttccttctgttgattattctccacggaaggcgactggagcaaaagaggtggttggccacccattaatacatctccttcttattgggacatttcgccctgctaaaggagtaatcatggattttctgtgaattttcctttaagcgttttctgtgttaaaaaaaattgtagtctgcctaaactgatttatgtgggtaatttatggagtacctgtttttcttttttctctcttcctttttcttcttgctgaggtggtacctttgctgcctcatccctggagttttgcatgagagttgaattttgagctgcaacagtttttcccatttaagtgttagagttgactggtactttatcaaagttccgtaagtacatttcatacaagaaatctcagcaggttagaatccggggactttttatttaaacctctaatgacagtgatactggcctgtaattaaggcatttctggaagttacttcaattgacttgcagaaaggaaggcagaaacccttggaggctggtactaaattcatggggaagagaggcacgggaagctgtggtttgggaggagggctcatgtgtagcgtggggcatatgtgtgtgctaactttcctgggtttctgtctgaattgctaatatgacattaggtgaaaggcatcttgtcaagaatgctgcatgtctggtggacttcctgaatatcaaatctgcgagccttctttccaactgcccctcctggccagcctcatgagacactgatgagaaaaatgccacagctttcaaaacagttaacctctcctttggcaattcacagcactgggtttattcaagcttacgatgacacagaattttcctccctttgaaaagtactggttaagtctttctgtctcctgcccttcaaaagcagtcattgtgtttgtttttttcagaggtaccatcagggttgtcagaaagtggaatttcccgccagatcagaatttcttcagccttcattcatgacctgagtacttttggttttgagggacaaacttgctctattttgagcactgaaggaaaacatctaactcccaattatgggtctgtgcacgtgaataattgggtaatgggattaaagtgcttgaagatacaacccttcctcaggtgccccttttcacacataaggaaagtggagtgcgaagggcactggctcacgggaaggagtggtggggaccccaggccttcagtccctcatttaacaaggttgtaaagtctgatctgacttcttactgcaagcaccgctacttctatgacatcctccatgccctttttatttcaaaagcagtttaatatgttatttcatttaatctccactgcaactatttccatttaaaattttgttagataatcaatagtgctctaaatatgaaccaatttggaagaaatatgaagaaaagtcatcttttagagacaacccaattcatgggccttgtaaacatttttattttttaggtaatcataaaataaaattgactttttaaaaaaatttggtgtgtaggtctatgaattttcacaaatgtatggaggcgtgtaaccaccactataatcagtggaactgtgcctttaccgcatcgaaccgcctccttccatctctaacccctggcagccagggatctgtttttcatcaccatagctttatcttttcaagaatgtcaaataaggagaatccacaggatgtggccttttgaaactggtttctcttatgggcttactttttttttctcagttagaacttttatttaaaatcaacaatccattgaacttgcctatttgccgaacaatatctacaggtagaaatttgcaaggataactctggataagcatagtaggccatctatttcatcatgaaggaaatttttgatgtactattttgaagactctatttacagtcccttatatttaaactatatctattaaattagtgttatattgaaatagccattaaaacaaaacaaaacaaaagtcttacatggaccaggcacttgtgaagtactctattatttcatttaagcaaatatacatcctttatgggtcatctgtgtcattttgttatttactcctcttgtacaagcttggcagggtttgagtggttctttaaaagagaagttggtgatagggagggaacttcatttctgtcccagatgctgacaccttgtgggtccttggtaacttccgctgctgtccatttccctcatgtaagggcagatggcatttgcatacctggagggacgccggctggagttacagatgcctgctgatgattggaatgttagggacttagtgacatgtgctgtagtcatggggtcctctcagacacttagggcatgcaggccttaggggagccctgtgcctttggggctggctgatgctggggagtgggactgtctgctgggttcaaggtggaaagggaactgctcctgtgtggtttgcctgccaaggagctaattaggagaatgggtttggtgatcttgatctgacagccaatgggagacttcctggggagctggaggagataagcctgtcaagaggctcccagctgtgttagggccaggattgtcattgctgctaggcagggctttggtcctcccaaaatgagagtgagcagattgcagcattctttctcatagcaccaaggaatcatagactccatggctaagtgaggtggaaccaaccacattgtgtggtcagccagtgccaacctttcttcttgcctggccttgtggatggtgttcacttttgagatgcaaactccaggttatgttatgaaactccacttctttgtctctcaaaaaaagcttgttaaaatgcgagtatcagtagccttttatttcaagcctcagatctcctctaatcaggccatcaattggccatactgatagctattattaaccattattgagaggcactagattatgaagagttgagtagttaaaagcagcatttctggagacagaccacatgattcctagtctcacctctgcacctggctggctgggtgacccttgcatgttgtcagcctttctgagccttggttaccccactggtaaaatagggatgataatagtacctccttcacaggtttattgtgaagattaaattagtcaatacatgtaaagctactgacagataccagcctttggttgtaagttaattttgaggattctatattcggccacctctgctactctgtcatcacattcagattgagaactgctgatcagtctaagtctcacagggaataaagctgaggtctacaaaggctcagtgatgtacacaggcagaaccagaactaggagtgtccctggacccttaatctcttcacactgcaaagcagaaagctggtgatctgaataaactgtttgctcttggggactttgctaactagaaatctttattaacttggactctgattttattgtcaaggcaagaataagcaatttttagatcaacaactccaagtcactggagtcacttcagcagagtttcagtgtttagtgtgatttgctgtgcccatttctctgcataatggccttccatgcatgtatgaggggaagtccatagttaactggaatgcatgcgtaggcagagctttttgtttgccaaccaggagtgataacggagtttattgccacttgatcccctctgccagcccatctgggtcaacttgtttttctctggtgtttgccctttccatcaaattgttccagagactaacaacctggcttagtgatgacaagtgtgttaatagtggagctcaagataaggcagcagtaactctgtttgctctgagagtttgctgcctgcctgctgagtgatccagggacttgtcagccctttgagttaatgtgtgtgaggtgctggatgcagagaagagcacttggtgtgctttcagcttgcacatgtgtcttggtgctcagcactccccatcccatgccaggaaacctctctctctctctttgcaggagatcctcatgccaactcccatctaaaaaatgaatgcttgtgatttggaaatactttttcatagatgctcagaaggtgtttagagttttggcttttgcttagttcacaaaccaggtaattcccagttgtccatatgaatgctctatagtcaaatttaggatcccaaattggcttctttcatcactgagcaagcttctggactagacagtctcttctgtaataaaattgctaaagtgaatgcaacaggaaggagaggaggaatttgcaatgacctctttgtgtaggtagatagtctgtgctttcctgatgcaggctcccttaacatgaggattgtgtatggggcagtgacgtactgcttctgaattatccatgcaaaatgtttggctctttgagtgtgaagcagcagcagttgcttgtattttcagacaagggtctcagtgcacggagaggactccctccaagtgttgtctttgcatttccattcatcttattagagcagtgcaaaccctgatgcatgaatgaactgggtttgtggctgaatgagtttggatttgctgagcaggctgattcaggaaattgtccttgattcccctgctgtttcccatgtatacacacccttcctaagtgaatgtggcatttgtattggatgaaggccatagctcagtatgaaacgtgattatatgtctactctaatcctcaacaggcaatgctttccacttagggtgttttagaggacatgtgtaccattggacttgcatgatatttgggtcaaaggcatttatggacagagatggaaggtatgatctatcagcttagaaactcaacctcaagagagaggagggtgtataaatgaggatgcataaagtaagaatggaaccccccccccgcacacacacacacaccgtccctagtcaaatttgcaaagacttacggatatgctaataagattgctgctggctaggggaattcacaggtctgcaaattctatgaattctaatgcctcactcagcaattttaaaaatgaatggactggaattaattgggagcctccttccatgggaattttggaagtattcttaggtatcacagaacactgtctgtttatgcataaaactccataaactacaatggaaatcactctagataacaacgtgagagatgggtattaccaggggcatatggcgtaattttaggtggtggcctgacccagcataggatgacacagactccaatgaggagagggttatgttttcttttacattctctttaacacagagagaatgtcttccctaggttctaccaggtctttaacacctctctaaactttggcaatcagcctccgctctcaggctctgagtctttgttggggtgacaagatcgaggtggcgtttaaatgatctgggttttcttttttgctgtatgtttagaattaccttctagttatagcaagtgagatgggctttccatttgtggtagtgaaataaagttcaatttaaaaattgaactttaaagaatgagatttaaagaaaaaaaattacacaattaattgtgtaggtagagtcccattataaatatgttgtcaggacaggacatgagtgatagagataaggaaaccctggcaataggagataatgactactttgattacacagggaggcagtaaggactggttcctccttcatcttgtaaacatggccactgtttccaccaggggaatactgatcgctgtcctttacagaggcactgtgctaagtaagtacttttcacacatctcatttaatcatctgaacaacccatgaggtatgcataataacaaacctcttcctttaaagatgaggaagctggaacttagagatagtaactggcttttccaaaaatacatggccagtaaggggcagaggcagcatttgagcacaggcaatttgactccagagcctggcacctcacccctatgccatgttggtaacacccagtaacagccccagagaaatctaatcagagaaaattccagtcatttcagtttactacctggggcaaattgagtttatggtgggggaaaagaaaaacacattttaaagaagggcaaaacaccatcctaaacttaatgagtcccatatgccatccctatgtaacatcttaattttcacctgtttcagtgtctgttctatttctctcataccactgcctgtagaaaatagatgcatgttcttgaaattcctactttttctcattaaaggttagattttattattctttctctcaaagtttggattgccaaagcttttggatttggaatatatttggcttgcatagatgccaatatttatacattgatacgaagattaaaaaaaaaactttagaggagagatccttttacaactagacttgatttagagtctatcagaaattttcttacatatttagcataagtattgtgagataatgtatgctttctaaaaatatacatgatgttctgctcagtcgaatgcatttatttctttctttaaagttttctgggtaaatttcaagagcatcgggatattacttaacttggtagattttattaaacctccaaagaacataattaactcattttacaaactgttaatgcttacagaaattcatgataaatgagatcacttaagactgtttcgggagaacaggaaaagccagtttgttaatgctggtcctcttctctattataatattgtgagaaatgaaggaatgtttatcactagctgttataaccttaatttgagagttctttaaatggcaattacatatatttacagaagaatgacactggcatttagctcaatattttcagcttaacagagtctcgttgggcgcggtggttcacacctgtaatcctagcactttgggaggccaaggtgggaggatcacctgaggtcaggagttcacgaccagcctggccaatgtggtgaaaccccatctctactaaaaatacaaaaattagctgggtgtgatgccatgtgcctgtaatcccggctacttgggaggttgaggcaagagaatcgcttgaacctgggaggtggaggttgcagtgagtcgagatcgtgccactgcactccagcctgggcaacatagagagacaccatcttgagcaataataataataataataacaacaacagagtctcccctgaaagagggattataaaaccagggcaagcctgtcaaagagaaatttgatttggttctgctgttttacattttaatatgcctgtatgatgacctagcccattaaaatttttttctttaaattatcaataggctgtctcaacctctgttcaattgaattttactctactctcccagggaacaaaatgacagagcattttgttctaggtaccttagttcttgttgcctattgtggcagctctatttccagtacagagtttcataggaaacctctcttcttctggtcatgcctatcacccagtcacctttcctgaacaattaggaattgactttctcttccccaatgctgcatttcactctcaccctcagtgtccagccctggtcatattgtctttagcccaatttttcaccacgccatagtctttcttgccactgggctttgcatgtgctgttccctctgtttgcacatgctgttctctctttctcctcttcttcccatccctttcccacagcacacgcctttcacccaaatagcacctactcattcttcagatgccagctccagtgcgactttcttgagaaacttcttttcaccttgatcttttgtgagcagctcttctagaattgtgttatgttcttccatgcccttatttcattttgggttcacattcattggggatgattatgaatggatacctgtctcccccattaactgacattgttaagttccctgaaagcagctactatctggtttttgtctcagttctatcccagcacaggatgagcactccattaagtatctgcagtatacataagtggacagaagtgtttgtaaacacccacgttctgccattcttccctcaatgccaaaggatccaactctaccacctcatcaaattcagagacagcttctgattttgagccataggggtgtcaacagcacaagtgcctgaagggcccacagaattcctggcatgtgctgtactttatcaagaatctgacagggaatgcggctgtccctatcaagctgttgtgcctgacaggcaccatctcggttagctgtgggaccactggtgtttctcctgaagctgcaggacagccagctgcaatgggctgactgatcttgaaatgaaaccctgcctccttctccctcctcctcgagccagagtgaggtggttttaacttctatctagacagttctgagattggtagaggagaaaatagaaagttcttacttaaattattggtgcagaaagaagaaggtgtatgtgaagaaagaaaatggacatttactgactattctgcaacacagcctgtgcagtgtgttaggatacacacccaacatctcctttaactcatctgttgccgcagactagtcaatgggagcaccaaaaactaggtaaaggctggtagttaaactaagtctgtttggctccaaagcttatgttggcaccacaacttcttcctaagacgaaggttggccttcactggtctgactcaaaagtagagaacatttactctgccagaggcaggaacatattcagctagcttcaggggtcctggtgctacaatcacttgtgtttctttcttttgtttttttatgtcaaaagtaattagcaaagaaattctgttttgattgtttgttttagagatggggtcttgctatgttgccccggctgaatttgaactcctgggctcaaggggatccttgtgagtagctgggactacagagcacaccacccgcccagccacctgtgtttcttatcagagcttctatctctttgttgttgcagattggagcctgggaggctgggggctggggagatagtcaggacccctagaagggcaggaaggatgcacaattattccacagaagaagcctgcctctgtttcccttgatgtcacctagtcaacaaagtcccacagtttatgagtttaacctacagaaattctaatatacctgccctgcacacattctgctatgagagccaagggattaaagatcaacaaaggcttccgagaagaatgcttggcttgagattaggaggaagaataagagtcatccttcatccatgatgaaagaagactggtgggaggagaatgggagagaatgttgcagataggagaaacagaatttgcaaagtccacgtggtggcacagaggaaggttcacctgagtcatggaggaaagtgcagcctggctggggtgtttagggagaggaagcctgatgccagaggtcaaggccatgacaggtaccaaatctgcccccacacattgttctctttccatcctgttgggtaaaacatacagatgtgagagatgggatctaagggatgggaggaaagtgggaaaaagctggggagaaagactaagtgatagttactaaaaataaaatttgctaagagcatgttttaaggatcgtggcagaaccagtcagtaataagggttgaaaaacaaagcatgaaaatgaggttaacctccctgttaacccaaactgaggtctccctggcttttattatcatggttatcgtaacacccagacacatggattggagtgtctggggaaatcccttcagtccgctccccaaccaccgcagctgtaggaaaccactaatctactttgtgtgaacctatttttaggtttctatagatttttctattctgagcatttaatacaaattaactcatacagtatgtaatcctttatgtctggcttttttgtatgcagcataatgattgtaaggttcctccatgttgtagcaggtatcagtagttcattcctttttattaccagtcaggcacttcttgactccctgaaaagggcatcccatcataaggcagtcaccggttcccaggcatggctggagcagggtgccatagagttagtgattttcctcaatcgtattggatctcagtggtctagataaagtcagcccggacacagccctctcagtttctctcatgccctgcttagcagcagctgttctctagctatatatccctgttatggttttgggtcctgggtcatgagtggtccttccattcatggccaccatgtacagttgtataggttgagtactgcacaaaggtgcccagctgaagaaggtacaagaaagcactcaaatgcaacctgtaccccttttgctaagccagaggctccagaatggtgctgtgtcagccagaggggagagtactttttttctaatgcattcaaggcttcctaagggcttcctaagggcagtcctttggatagcatgctgttgtctgtggcacttgccagggctcaggtcctggatccagttaacatgtcttatatttgagttaacaagattgaagtggtaggaagatagaggataaaatcacagatattttctgatttatggatttgttctcataagaaaatcttttccaatttgtgttcggagatctacacccctattttctccatcagtcctcttgtgagttctaacatctcttgctgttcccatctgtgtttctaactttgaggttgagcatttctgagattgaattggtattaaaaattaattttcacaaaagaagaaaatcatgactttcagatatcaaaatgaatatgtgttaaagattttattctactcctattcaatgaggggaccaggcagatgttataaccagttgaggacaggcaggacatggtggctcacacctgtaatcccagcactttgggatgccaaggtgaaaggatcacttgagcccaggaattcgagaccagcctgggcaacatagtaagactctgcctatacctgaaaaaaaaaaaaaaaagccaggcatggtgatgcctgtctgtagtcccagctactcaggaggctgaggtgggaggagcccttgagcctaggaggtagaggctgcagtgagccatgattgtgccactgcactccagtctgggcaacaaagggcaacaaagcaagaccctgtcttgaagaaacaaagacacaaacataaacaaaaaagaaaagaacagacacttacaggtcagtaatatttaaatgaatgtggaaacagaggcaaaactgtttttttccacaaaggcaggagagaagtcaatggaacttctcttggacaggacagaattttcatgtccatggacaggaattatttgcattgctgtcacttatgtacaatttacagaattataaaataacttctatatggtcagaatcagcttaccaagagtggcgttctctggagtctgtcaatgcatcccttgtagcagcatacttcattttcccctgcattggtaatttgtggtgtttctagcgcattgatgaacctaggtaagtttttaccattccacttgagatttcaagataagcacaccatttctttcatgtctgaagtagtctttggtatgttggtgttctctattagaggaggaaggatctggaagttttcaaaggaaactggtttatggaaagagcaaatggtggggatgtactgtgggttcgaagggaggcatgtgttagtctgttttcttgctgctgataaagatataactgagactgagaaatttataaagaaaaagaggtttaacagactcacagttccatgtggctggggaggcctcacaatcatgacagaaagcaaaaggcaagtcttatatggcagcaggcaagagagaacttgtgcagggaaacccctccttataaaaccatcagatctcatgagacttattccttatcatgagaacagcatgggaaagacctgccccatgatttaattacctcccattgggttcctcccatgacatgtgggaattgtgggagctgcaattcaagatgagatctgggtggggatagagccaaaccatatcaagacacctggtaggccaccaactgggaaataaggtctggattttattcttaaaatcatcacacccttgctgtgtgacgtttgggcttgccatttatctccctgcttctgtgagacaggaaaataagtgttatttgtaaagtgtgttgaggttccctgatgaaagttaccagttaaccacaaagtagtgttatgaatctgccctttgtccgcttgctgggattggatgccctgggtacatttgtcttccacatctttcatctcttctcaccattcacttccgctgcagcaagtgggcaccctgccatgggcttacgtgttttcagcagctgcatttggatttttctatttacccttgaaacaatctgttataaaaagccttaaacatctcccagtttctttcctttcctctaaaatgtttaagtaaatagttgatggaataattattctaaatgtagtagagttcacattgtcttaaaagactggctaaaaataaaaaattggtcttgtcgaagcttaatgagattcttcagctttgctgtcccagtgctgcaggtggtgaagaggaaaatgctggagcttccaacaacaacacaccccccaaaaacctaaaaacaaaaaaaagtgtggaaacacttccaaaatctactcatctaaaatggactattcctattcatcatgaggggatcttcaggtgtattttcagtctatgaggaaaaagccacttttacaggaatgtctgtaacaaatttgtgatgtaatacagtgtctactccagtagcttcacttcatgaaactgaatagcagagggatggataatagtagctgaaagacttatttttccttttagctgtgacgctttaatgactttgctatccctcaactgtccccttgggtggaggttatattctttaacgaatcgtcatgtgattcttcacttttaccataccaaatcctatatactttgctttaatttttgctttgcttttggtgaccgcatatggcagagaaaatattttttgtcttcactgccattacaaatttccatagtcctgggttgaggctggatttcggagaccaccttgtttttttccaaatgcaggagagaggaaagtagtattagcagcagttcaatccagtgcacgaaatatttgttgccttttgggatgcaatactacaactcatttacacttcacacatttatcacttttcttacttttgatagattatcttcccagccattctagccaaactgatcatctgcttctgaattcccaaggtgtttaatatctttcctactgatatttccatttaaccatatggaaatggttaaatggtctgatatggttgtttgtctatctgttgggcatttattttgtctctccatcagaaaaaatacattccttaaaggagagaatcatattttatatttctgttttgtcctctatagcacctatcaggtggccagagtcatagtagggtctgagaaaattcttttccatttgcttaaatgcaaatgacattgggtaaacttgtactaagtgacacagattgtcacaaaggtctacaacagagcatgctgattatatacatatcatcagaggacagacttgagaaactcagcatgctcatttttggatttgagctgcatgaacagctcttggtattgattaatggaaagatacaagcctttagttgtttggatggaaagaaaacatctctagcattcttttttctttgaactcttagaaactgaaaagtcccaacagtccatgtccaaaggcgtaactgcagacttcccaggcagctttggagatcatccttctccaattgtggtacttggggtcaagtgtagaagcagggagaccacttaggaggttattgtaataatctggtgaaagaccatgacactttgcatccaggttggggcagtgggagtggtgagaaatgtgatctgttgcatcgactttgatgtagagtcagttacatggagaagtgattggtgattccagaagttcagagaataagccccctggggaaggtcattttcagtgaggaggtcattcatgtccctgaaagtcagttgtctgtggcagagcttgggtgctggtgcttttgctgtggtccgtcccagcttctctggcaggttggcatgtggactgggtgttggagaaactgctgaggtcttcctttccctggggaggtagtatcaatgattcggaagttttaaaaatgcatcagcttgctggacagtgccctcaatcctggcccagacccatcgtggaaaagctatcatggtgcagcctctgcattttgcattagttgacctctttatggtaaggggccaagtctgaaccccagggagctgaggcccaggaatgctccttctcattagagtttggcctggaggtatggtcctgaaaactttgcaggtgagccctgttagtggctcctcaccccttcttctcctcccttgaaggagggagagcttcccccaaccatgctgggaaggcaaagctctcttaaggcaacgaccacttgctgagcacatctcagggcagagacaatgaagagaaggcatgaaccacacagccagctgacatctcaggaaggtgtgggagtttgaagaatccccgctgtgtgtcatttactggctacaggacattgggagaattacctaacagccctgggcctcagtttcctcagctataaagtggggataataataatagaactatcttctaaattttttgtggggattaaatggggaaatataagtaaaatatttagaatagtgcctggcacaaaatatgtaccatattttgtttgctattaatattttatagtattattcatttataatatgataggttatgtagtgtgtttggctattataaatatattgtgtgattagtatattctcaagccaggcccagtccccagcctttagaaacccactccctggggatctggttcagggtagttactgggtcaatctgtgtatgaacaaacctcacgcataatacagacatctcgaattgagtacctgctgagcctggatctgtgttggtaacttcacatccatgatccacaaatgtctgacatttattttagaggtgaagaagttgaataccagagggttaagtgacttccgcagggccacacagcaaggttaaaattaggtcccctgacgccaagcccctctctgtgatcaatgagtgtttcctgatgtctgcagtatgccctttgctgtgggaggcactctaggcagttattcctgaactggctcaagattctgagtttgcaagtcagggattaggcctaggcatctacctgttagcaggcccctgcaggaacttccagagcagatggcctcaatggcccaatggagacacaatgctagaaggtagacgaaggatggtctcagctcctgaggagtcttattacagaggtgatcatcaaattacatgaaaatgcccagcaggtgctgattctgtgcgtgtctgtgaggctcactctgagatgcagcagcctggttaagcggagaggactgtggtactcatgttgactcagcttagggaattaagatgccctgtgaatgtggagaggtggggcaagggcaaggaaggggggacaccgtttgaggaaggttcagaggcataaagaacttgacatgggacagggctggtgaggattccctctgggacatttcccccatcttcctagtgaagacccatcctgcaaaatccgtggatggaaagcagcgggcataacctcccagggtggattacataactgggctgggccttggctggggctgggcctcccttgccatccttttctcctggttctcaggtcctgtgctcctctcatctacctctctacctcctgctgagcggtgatggtggagcagggcaacctgctcacaacttcctgcaggagtggatgatgtgcatgtgttttgtggggtctgttgtagtcttatgtcttttgcctgtgagtggttaggccagctgtgccctcactaggggagcaacaattgggactatggcaatggaaggcagaccctgtgggcttttggaacttccttctttttcacccatcctcctaattttgcttctgtccataacacacaatagggcgttggacaagtcaattcctctctgggtcccagttttctcctctaaaatacaggcttacgactaggtgatcttgcttccttctcaaagtaacattcaatgacttttttgaacccaatctttggaacccctcttggtgttctgttcttttggctttgagaaggcttcctcctcctgtattagacagatactggagtaagagcccaggttttctgggtacattttcctttaaacctccaggcaaactggagctagtcaagacatcagaaagagtatcctgaagctcagggttgtgctttcagatcctacctcacaaatattcagttggtataggctctctgaggtctaagctgtccaaataagaaggatctgccttctgtgtggttgatccagttgcccatgaaggagactctgaaaagaaaagcccctccacactcaagataatgattgccaaggttttgcactaaaagcacacatctgcctgggactttatgagtgatggctgtgtgttagctgcaggaggcaacaggaggcaatctgcccgaatggtggacaccatggccagccaaggctgccccatctcggtcttcatcacttcccttctcagtttctctccccacaaaactcaccatgagatggcttctgcggcagtgaggtttaccatccaatagaaagaaaacccatggcagttggctaaccgaccaaacttactccatttcctctgacaatcgatagttattaatcacctacattctccagaaggctgtaaaccgccctcccttctgtgtctctgggatgacaaatggagtcggggttagccagcccggctttgtggcatccaatgtgtttgtgtttgtgctttgggcttgtcagttgcctttgctgggatgaaatagtggggcttccactaggcatggttcagcagctctgctagtgtctgtgctttattgggcaataaattaacagtgagcactgccaaggaaatagataaatggatagggtggcaagcacatttttaacaaggaaaatggcttcgtttctcagtagcatcatttaaatgattagctcagttgtgtagtttccttgattaggggatggggaggagatcttaaataaacatgtctgtaggaagaacattgtgggggcatcctcactgcccttctttggaaggtttagggaaggagaggggatttgtttaggaccctaggtctgggagagtcttgcattttagtcatgtgtgatacatgactaattctgcctgtgggttaagcctataaatagtgtgtgattctggctggccatatctggaggctataatcaggatagtcatacttgaaagagttaggagaaatcttttatggcttgtcatgatccttaactgcatccccatggtaaacagtggcaagagggaagagagggaactctttgtttgcaaggcaaatctccacaaagctaagaggaatgctagccatcagtacaaaggaaaaccttccaggctcaagagaagggcagtagaaaacaaaaacatgaatgcctcctttccatgtatgtacacgtaaacataaaagggtgcctgctttttcataactaatttctagaagtggtgccttccccactagaatatcatctgaataaggggtctttgtcatgtgttctctgtgatagcccctgtgctgggaatggtgcccagcatatagtaagaaatcaacaaatacacgtggaataaatgaacttacaggtggactgctttccaccctccaaattctatccatgattcctttacagcttaattacacttccaccaggtccttccccagccactcctgcctgaaggactgtcctctcctctgctcaccagttatctcttcttttcctttttattggaaattgagaccttgttttggaccatgttttctattgtttcaatttgacattaaaatcttatagtattgatctcttttatatccattccacaaaccttttcaggttgctataaaattttttatctgtgtttctctaggaatagatgagttgcctgaatgtgaattcaattcatcttgcaagtataatagcttatcataataagctcttcatgtaatgtaataagtacttcagaaaataatttagcctttactggattttttttcccttcaaatgattggtttgtatgcttaatcactcaagaactcagctttctggtagaaattgaacttgtatttgcctgtgaccaacctactgatttttgttttagaaaaacagaaacaaagggagaataagagagaggcaggaggaaagaaaatgagagagagaaaaaagatgaatgtatatttacatctatagcttacttcacaataggttttgaggacttatttacagctaccttatagaagatatttacaaaaagtaagtgctataggttttgaaatcagagaaaagggtagatgaatagatgcttctgctttagggaatgtatcttggtaacttctgataaaggaagctttttaagctttctcttctctggcgcttataataggtccatgttttggtagggggtctagaagaaatagcagctctttgccaagggattgcttattggaacaaatcatttgcaatagaaatgtgtttactaagataagtgccattttaaatgtagtgtgctgtacccctggcaaggaatcttaaaggtgactcaaagcctttttgaaacactgccatataattaaagaaaaccaacttaatgatctaacatttagcattattctttacagttttacacttggactggaaaacagttgcaaaaatagcttcatttaattaggatgagaaacataatacacatatatagatgcatgtgtatatatatatatatttacttcattttaaaaattattatttgtagaaatagtctagtatgtgtgaccaagaaaattaatttaagatttgtgctttattcttcccagtcattcatcaacaagtattcattgaggatgcaagaggacctcaggagggatgtacattcaagacataccatcaaaggggcttattgtctagttggggagataagacatatacacaaaaatagttaactgtatgtatcaagtattatggaattgactgccttcaaaatatgaaagatggaaagtgctttggaatatcaagcaaggggaaataggaacctatactttaaggagggtattcattcattcattcaacaattgtatataaagcatgtactgtgttctaggtactcacacctgggtgctagagatacagcaaggactgaacagaccaggtctgtgtccttacagaatttattttcttttgaggttaggcaagcaatagacaagtaagaagtaagtcaacaatgtgatttcagggaatgataagccaatgaaggaaatgaaacagtgtgaggggacaggccagtgctgtgtgcacctaactgcatgtacttgcttgctcacaactcagtcgtgctttagaaaggatagtcaggaaaggccttgtaggaggagctggcctggactcagacctgaataaggagaaataacctggagaagggatggcattctgtcctcaccttggagggtcaggaagatatggtttggaggataggaaagggacagacattctagaacatttcagagtatctgagctttttttttcccccagggtgtggggttgtggtgttttgcatcaggtaaggctcaggtgaatcaatgtataattttggcagccagaaggctgggagctgttcacaatgagagattttttttgcatcttccagtaaggccattctgggatgaaagatgtcagagtgtctggcaaccaactggcagccattgaactggggatttatttagcacttacttctagagagcttgctatgtgccaggcactgttttgagtgttttacaaacatattaacttactcaatccttacacctctttgtggtagatgctcatcttcggctcctctgtcagaggcaggaactgagccttgagagttacctgctctaggccacatctctgggaggtgttctagttatgctgttctagcccttaactcttgtgcttcttttttgtgagacgagagagcacccatgtcactcaggacacttctaagtgtctctagcctggaccagcagaatgagagttgggaccttttctaattatttaagggatctaaggactttccaccctgatggaaacattctcagtctgcccagtatggtacccacttgcaacatgtgcccattgggcacttcagtgtagccagtgcaactgaggaactgagtttttaatttgtgtttaactttaattaacaaaaatataaacctaaaaactgaaggaatataaaatgtttgtctgttaaacaatactttgttgttttggtaggactaattttcacaagatgcaacaattgttgcaacacatgaaacactgttatatttcagtgggggtgtcaggtgcatgaagtatttctagtatctcattaggaatttttaatattaatgacatgttgaagtaaaaatattctggatatattgggttaaatatgaaacactttacacactaatattatatgtttcttttttttgaaatgtggctaactgggacattcaaaattacaaatgtggcttgaatctttgaatatttctattagagggagctgggatgaagtttaccctcaagcctctaaaaagagcgcttgggccaggcacggtgcctcaacgcctgtaatcccagcactttgggaggccgaggcaggccaatcacttagtgaaaccccaactctactgaaaaaaaaaaaaaattagctaggtgtggtggtgtgcacctgtagtcccagctacttgagtggctgtggcatgagaaccgctggaacccaggaggcagaggttgcagtgagctgacattgcactaccgcactctagcctgggcaacagagcaagaccctggaaaaaaaaaaaagaaagagagagagagagaaaagaaaagaaaagaaagaaaggaaagaaaggaaagaaagagagcttgaacaaagaggaaataacggctgtgttttgggtggacattgagccatcatcctaagcaccagttctcccggacttctgggctcttgctgagctcactccagttcccagttccccgggaccaacatgcaccactatttcttgggttttgcagatggaattgccacatggatagagattggtgggaactcatacatgaacacaacccccattttgctcaaaaatggtgtggatttagttggagttagagagtctctcaaccatatgtgacttctgccttctgcccttgcctgttccttgacaaggaatgaggcctgcattgccactggcaggaagcagctatccacccagcacaatgcttgagggccaaatcctgcacctggtcccagaggtgcccaaaagcaggaggtgagagggctgtgcttgcttgagggaccccacagagccagggaacagcctgccaaagcaactcaggctactgaaatccaagtggcagcaaatggccaatcattgtctgggtctggctctgtcccagcctctacttacctgtatctcctcagaggtacagcttggggcagcctccctatcaccgtggtttcaaggagaggtgtgggtttgtataggggagatggggctcctccataactgagtcaactgaagactcctccagggtcactcaagtggggacattgaagaccaggtagctgcccacttcgccagtgcagagacctgagtcccaggcagcccagatccctggagatagtcacatgttccatttgctctgctgtgttagcattaagatcccacccattggctgttcaggtggccacggccctgactgcacactggaattacttggggagctttctttttctaatacatcagaaaaatactgatacctggtcttccccacagagatgctgatgtaattgctctggggtgtaacctgacaatccaggttttaaaaactctgaatgaagttatctttccctgagaggatatggtgcattgaaatgaactttctcaaagtgcttcagaattacagcagatgggggtgcagggtgcctgttgaaaatgcagagttctaagctgttcatcagacctttggaatcagaatatttggaaatgcacttgtaacctacagcccaagtggatattcagtaggctgccatttcaacatcaccctgtgaaatcattaacaactcagtatggatttgctccttattccttgtgctttttaagaagtccaagaaagagagttaaggtaaaattgaaaggaagtaatctctaatggtgaaatttcaggctcttagatagagaatacttttcggggaaagggggtcttctagaagcccctgaaatgaagacaaggagtgaccaccaactccttgagccagaactggggcagttcttcacttggggactctgcccttgtgcagtgggaaagcagcttatatcaaggcttggccaggcctcctttggtcccaggctggggactgctgggacttctgccacaagatgcttggattgtgtttctttgcattggtgcagcgtctcctggagactgcttttgttcagtcactactgaggcgtgtattcattaaatcactgtgcgcactaaggtagcagtgcagagacaccctctctgtcaaaattgagccagcccatcctgcatggtcttaagttttcctgagaaaagtagccataagcgatgggctcccactactccctgctttattacttgaggtacagagagcatatgacacattcgaaccccatgtgagttagagttcagtatgggatcagaggctggtttactcttttcaccgggaagcgatcttgagaagcctgcggatgccacttcccatgacctgaggggctgtgttttatggactgcttttgatctgaaatctagagatccctgttttcatccttgtaagcctccagtaactcaatcacagtagagcagtccccatcatctccagcaatttattaatcatgttcaatgccagacaaggccttaaaaaaacaacacttactcatcagcagaccactagcagcatggaaatgctactggcttctctcggagaatctcctatactctgcgaacagcatgagtgtctgtgtgtgtgtgttttagtgtgtgtgtgcctgtgtgtaggcacagaactatggaggttttagacattgtcgttcgcctgctggtatatcaggttactaaacagagaactagaaactctcctagagtggctacaggagcactgcagattctcaactgtgcttccccatcttctcctggatgtttggcagccagtgtgtcaggatgtattaggcctctctccaaggacccaagtgcaacttaaattggatgaccatattctttggcatctactcagggcacttgtgagagtggaaaggaggtgctcttaataattattccaggacatcaagcaaactgggaagtagagtctccttaggcatattcacttggcagggtctactgtcaagaagcgtctattcttggcttattaaaatgccatcagaaatcagtcagcattctgatataacagggaattccttttatggtattcttggcaggtgatctcctgtgtcaacttaaatgtccccagggactgaaagctcagtgccacatgcagcagccgttctattgttggatgattgtcacattagattgggactcattagaagacttttctgatatgagattggaaaatatgctaataatatgtacagtgatgcaggcaacttaaaattttcttggagagaaagagagggttgctatggtttgggaaaatgagtggggccgatgcttaccctttgtgaacccatttttggagggtgcagccatcacagcgatccaagaaaaatcttcctgccttggatgctctttcaccaaataactctggaaagctgatgagatgaaacagagtttcacaagggaaagtggagaagaagtttctgagagacaggaggatttatacccaccaattcaggaaggagctttggagtcatggattaaaagaacaaaggcagggagtccgacctggatttgagactaagctctgcctcttatacagggcatttaagctctctgggcctcagttgctccacctttagaatggagatgcctcttcctttttgaagacagtgggtcctccctcaattgaattcagtgggacttcatcgcttgctccacacagagctcctccccagtctgtcacattgagtgcaaaactctgcctaggtccatccagtcactcaacaagcatccatgggggaagcattaaggagctttagatgcactgggttctgtgagagcaatgttagtcttcatcttcttcactccttctcatcctccttccatggaacacccctagactccacagcctgcaaagctcattgccccttctctggagagtcctcctaattcatgtgcaaattttactcactagtggggtcatttgttgagtgtctgtccctacttcagactgtaaggttcatgagggcaagggctgtggctctttggtcctctgctgcatattcaggcttagcacaaagcttggtatacagcagtcatttaataaatatacattgattgaataaatgaatgagtgaatggtggggccacagccatgattgataccctttccatcctcaaggaggagatcacagacaagagactcagaagaaaactcatgactacaataaagagtaagaagtgctttgtttaaagcatccttggggtctttcaagaggtcccttgggtgaagtagcagattcagggtaattagggaagcctaagagttgatctttctgtgcctgaatggattgattattcaatagaagaaaagaaaagaaacaacaagacttaaacctattcaactaccctgtgtacttgaaatgtcatttaaagtaaaatctagcatggcaacttcaaataacaaacataggtaatgctggagagggtgcgccaagctggccagcattcttacgaagtttggctggcacagagcacacaagagaagtcatattattgccaaaaagttcttgcagtgggtggaacctggacaaagggagctgttctctcccctctaagtcttagatatagctgggaaaaacagacagagtcatgaccctgggttcctttgtttttggaagtcatgtggacattcttcttttttagcactgtttctttctaatgataaaggaaacagtatattgatgaactcctatttttcatttgtggtgctttctgaatgctttctttggaacccaaagtctcctcagccacacctttacaagttttatggttctgggtggaagcatgttttcagaaatctaagcctacgaggtatttttttttttttttggcaggttttcactctcattgcccaggttggagtgcagtggtgctatctcagctcactgcaacctccgcctcccaggctcaagggattctcttgcctcagcctcctgaatagcagggattacaggtgcccaccactgcacctggctaatttttgtattttttatagaaatgggatttcaccatgttgcccaggctggtcttgaactcctgagctcaagtgaactgcccatctcggcctcccaaagtgctgggattataggcatgagccacagcacccagcctaagcctatgtatttttgttttgttttgttttgttttgtttttagcagccatggcatcatggttaaattcatgaggtacctttcaatggagatgatatttcaactttaattaaaaaccaaacaccttgctggcattgtccagcccaatgaactagactctgaaaatgattttgaacaataattcaagataaagagctccagccggttttctcccctttggaagccttcaaagtatatttttatagatatattaaagagattttgtccaaatggcacatacctaaacagtttaaaatgtttttatacccatgttcaaagaaaaagaatatcttgaaagaataaactttttatcttttataaataaggttaaaagcagtaattctcaaaatgtggtctctgaaccagcagcatcagcatcacctgaaacttattagaaatgcacattctggcagggtgcagtggctcacgcctgtaatcccagcactttgggagaccaaggcggttggatcatttgaggtcaggagtttgagaccagcttggccaacatggtgaaaccccgtctctacttaaaatacaaaacttagctgggcgtggtggtgcacacctgtaatcccaggtacttgggaggctgagacaggagaatcacttgaacctgggaggcagaagttgcagtgagatgagattgtgccactgcactctagcctgggcaatagagtgaaaccctgtctcaggaaaaaaaaaaaagagtcttttgatgctatgaacatcatctggcttctggcatcctgctttgcccgagaatgaaaattccagttccagttccagaaaaaaagggcattcttcagttttgtgtcccctgccaggtcaactctgaacctgtagtggatactcagcaactttgtgcactgaatgaatgaatgaatgacttgtaggctggtgtgggaggttaagagaaatttattctagcacataaagatcttctgatggagtggatgagggatggaaattggtgatcaggctggggctgtgctgaaatatgcaggcgggttatgacagcaagagaccgtaaaccctgaaaggatgaaggttctcctcacatataaatttgacacatggaaaaaccatgcagtaagcttaagggagcccacctcaattctgatttcttcctgataactatgtcaaagctcttaaaactgtgcaatgaaagatctccacgcattttctggcccttgtcttgccaattctttcactgtgtacctggtgtgcctggtctgctgaactatgaagcatactcgaacatcatacacatgatcttcctttttaaaaatgaccttgagaagataacaagtgacattctacagacagactccatttcttctcttttgtttgcaaaagtgtgaggctgaaggaggaaggaaagcttgggttacctgaccacattctcatccacccaccctcaaacaaatgccccacacatgtagaggatgtggttttctgactgtttatctccagtgagccagagctctaggtcccctgtgctagagggggcacagaggcattattatcacccagtcctcactgggtgagagggagaatggtgagaccattgtaggaagcaaggtggaatcaggggctgtgggccaggctttcgaaacttgcgcgaatacacatgcagaggtttatgctgctgactctgccttccaactttccaggctgtaggagtgggaatttattgagcatgagggatgctatcttgtgaaactttctacttcattcgggaagggtagtttgtctgtaagaattcaattgtaaatacaaaaataccatttatttctgaggtgagggcaggaaggagagatgtcagaagtagacaggttagggctttctctttggagacctggatttcaacccactgaaagtcttaacaaagaggcatgctagtatcattcttagcaagcccagtccattgttatggtcagattcgattctgcagaggagaaaatggagtgtgacatgtttggtgccaggaatgtgagcatgcacctgcacagccgatgttggtgtcatatcgtcagctgaatggtcatttagcaattttggccaactcccttgacactatagggcttagatggcattgctttctgggatgcactgataagccttttacataagccttttacaaagtaagaccttggtgccaaaatccttgctgtagaagatgaaaattttatgttatttctaggggtgctttcaatgttccattaagccactgaggagctacaaccaagcttgaccttgaggtttagtcttagggaccagatgccctctgtgtgtttcattatcttccagaggaaattgttgagtgtttgtaaagtggttataggatgaagggaacactcttttaaagttcctaattatatcttggactttagctacagttaccgaaagacaaaataaggtctctaaaaaaatcatagccaactttgggcattggttgtagactagagtgcagtgcaagggaaaggcgggacacacataacatctctgtggctacatggggatagattctggaaatgaaaggagaaattccagcatcctagggggtaagatcaatgctctagagagggaagagtcacttgcatgtaatacaagtttcttggagatacccactgccattgaattgagagatgtcagtattcctgtgggagggttatgatgtttgagtttttaaatatacatatgcttctgaattctacttgtgggttctcagaattttccttccattttgtaaattgcagtaaaatatgcataagatttaccatttcagccatttgtaagggtacaattcagtggcttttagtacattcacattgtgcaatcatcatcactatctgtactagttatttgcattgccataaaggaatacctgaagatgggtaatttataaagaaaagagatttatcttggttcatggttctgcaggctgtacaagcatggcacccacttctgcttggcttctggtaaggacttcaggaagcttacaatcatggcggaaggcaaagggagagctggtgtatcacatggcaagagagggagcaggagcaaggggacaagaaagaagtgcagaggtcccagactcttttaaacaatcatatctctcactaactcattaccactggaaggacaccaagccattcatgagggatccacccccatgaccaaaacgcctcccatcaggcctcacctccaacactgggggtcatgtttcaacaggatatttggaggagggaagacatccaaaccatatcaccatccatatccagaactgttttcatcttacaaaacagaaactctgtacccattaaacaataattccccacttctccctctctcccacttccaaggaaccatcattctacttcctgtctcaatgaatgtgactactctagttacctcctttaggtagattcacacaatatttgtccttttatgtatagcttatttcacttagcataatgtcttcaagggtcattcacgtcgtagtatggaccagaatttccttctttattaacactgaatagtattccattgtatggagagatctcatcttgtttatccattcatctgtccatggacactttgggttgcttctaccttttggctgcaacaaacatgggcatataagtatttgtttgagtcccagctttaaattccagttttgcctttaatgtaatttaacaactggcagggtttgagaagtagggcaaagatagccacaaatttagtccttggtgacagtgagtggcaacttctgacctgactacgctacagaagatttctcatctcataaacctaattaaattaaaaatccagttggccaaacccacatgcacttaagtcagacaatttcttaaaaagctcattagctgcaaacttgagcgctccaccagcagatggaactttttcccctaggtttttcaatacttggacaggaaaggtcttccaactttagacctcaaatggaagattttatcatgcttgccagtgcatcggttttaatgtcattggtaaaattatgcaaaaagcaaccttttaagttttatgatgcaatgatgtaagatttcagtgtcattaaacctcggcttgcaggaaggacacaggttttagggaaagttttctgacttcctgttacaactgctttccctcatttcagttataataaattaagccctaggaggaatatattgaacttttctgtatttttaatttgggcaaaatgagatgaacatcatcaacaaaatccaggatgtaggacaacactcctgcgatgtttggggaacacgaacctgcagaagttcacataactctggccctatagttatgtcacaggcctcagaagggaagagattgggcaattggcttgtagtaatcatgtcccagattcttctttggggagcattaaaaaatgagaattcagacactgtgtctatctgcatgagtcaagttttcttctgccctctcaaaaaaaagtccatgattgcagttaactttgtctatatactgatggatgcatgatttatagtaaacttatagtaagagggaaccctgttgtttcccagggtttcgtatgtatttatagtcactttgaagtgacctgatttgaaaatggacagagacaaactgctggggggcatgcaggtggttaataaatactgatagagacccccaggtggttaataaatactgacagagacccggtctttctgattagaggaatcacagtttgtctctgtgccccttgcagcgtgtttgtgtgcatacaaatacacacaaatatattcacttattattggaacgttggcatttccattattttatgcctctccatctcactttcttatgacatctgttttcacagattcctagtcctgattcaaatctgaattctctgcttcttcacgtaatgctccctatatctgccacctcagttgaatctgtttttcctagagacatagttgtttccctcactcctctctctggaggttgctgtttctgtttttgtttgttttttgtttgtttgtttgttttttgagatggagtctcgctctgttgcccaggctggagtacagtggtatgatctcagctcactgcaacctccaccactggggttcaagcaattttcatgcctcagcctccccagtagctgggaatagaggtgcacagcaccacgcccaactaatttttgtacttttagtagagatgggttttcaccatgttgcccaggctggtcttgaactcctgacctcaggtgacccacctgcctccacctcccaaagtactgggattacagacatgagccaccatgccgggccatctttgtaacccaggagtgctggacactctggcccttcattgcccttctgttcttgtagaaacctgttttctccaggctcctgccatccgaccaaatccttcctctctctgtccttcctgatgctgtcacccatctaagtccaggcccctccccctattcagggatggccctgtcctcttctattctcaacctcagctccccccatcccctttgagtctgtgtgcaggactgtccttgctatccctgtgtgtgtctcagaccctcgacctctaccaccgcggtgctcttcttcctgctccactttcaccagggatcccctggatgctgccattacctggaactgcatctcacctttattccgggttataaacttcagggtctcactcagtgagggtaatccatgtttctcccacctctcttttgcttccactacactcagtcttcaaactaattctccagccttttctccacatatttatttatttaacaaatactgattgagacactttgctactttcttggaatttcgtgataactaaaaatggacacacacccggccttcatagaacttgccatccagcaaaggaaagaggagagcaattgatcaaaatgattgcacaaagacatgtaaaattgctgctttgctaactgctacacaaaacagaatacctgtgggcagggaagtgacagcagagctgatttctgaaggatgggcatcccatgtgagcaggtgaggcttctgggaggaggaaagtgcttgtgcgaaggctctgtggtggttggggtgggaggaggcaaatggagaatgagaataactgcaagttagattcctggagtctagatgtggaagcatgtgaaataaagccagagaggaggaaaagaccagagctttcagggccttgtggactctgtcaaggattttttttttcttcataccaaaagttatggaggacatttgaggtgatttaaggagggattctctccgatttacatgtgtgtcctaagaattcagtccattgcacacagagtatggcttcatagtattgcacttttggaagcaccagatcctaatgcctgtaaaatcatagagatttttactaggtttccttacatgtgaacaaatcagttttactcttatctggcaatcccatgcattttattttaatgctataatcccaaataccaactacaaagcccctctttcttcttcctttctttcatcttgaatacatctctacttaatccgttgtttggagtcttggtttccagtgaatcaatttacagcatttttgtgcatgtgcttccataagtcaaatgtgatgtttcatagtgctagcttggtaatttaggggacctatggatgattaaatggctctgcagaaatattacagatatttttaaatgtatgataacaaaaatccttttttggtggcaagattatatattatatatatatttttttgagacagagtctcgctctgttgcccaggctgcagtgcagtggcgttatctcggcttgctgaaacctccgtttcctgggttcaagcaattctcctgcctcagcctcctgagtagctgggattacaggtgtgtgccaccacacccagctaatttctgtatttttagtagagatggggtttcaccgtattggccaggctggtcttgagctcctgatctcaagtaatccacccgcctcagcctcccaaagtgttgggattataggcatgagccaccgcacctggcctatatcttcttctattgagaaccattcatgacttaggaatgacaagaacatatcaactatacttgctaaacagtaaagagaaaaaaatcattttctttttcccttaggaaaacactgagactcagtctgagcttctggaaggctaaagcctgcaaaaacatgggcttttcaaagctcacagaggcaaggagagggaggcgatgggtcagaccaccactcaattttctgtagtgatggcagagctgagacccagactcaggagaaagctgatccatggcccttctatgtcttgtgttagttttgtgggatgacattctgcatgagcaattgattgtgctgctggaaacacaaactatgaatctgagtgtctatggagtttattcttgtgatcttatgaaacaagtctcctgcatacagatttagggacaggcatattgtcagcatgttgaatcagacttatgtatacatggtttacagttagcataagtgagggctaccttttcaagccaaaagtttttagttcctaccaaggtcccatctcataatcatctgtttcaatctcattatttcacagattgggaaacttagacccagagagattaggtgacgtgcttaagagcatgttgcttataggggcagagtggagattcacacccaggtcttctgtgtcctgtgctcttccttctccacatcactcatcctgtgtgcctggttatattagtccgttttcacactgctgataaagacatacccaatactgtgtaatttataaagaaaaagaggtttaatggactcacagttccacgtggctggggaggcctaacaatcatggcggaaggcaaggaggagcaagtcacatcttacatgttggcagggaagagagagagcttgtgcagggaaactcccctttataaaaccatctgatcttgtgagacttattcactatcacaggaacagcatgggaaagacccgcccccatgattcaattacctcccaccaggtccctcccacaacacgtgggaattgtgagagcgacagttcaagataagatttgggtggggacacagccaaaccatatcactggtgtctgtcctttcctagaacagccaggtggacttggaatgtcaaaaattcttcttcctttttccttggttttccatttctcactttctctccccgttccactttgggagtctgaaatgagggtggtgttgcttctctgcctgatctgatccttcctttatatcctggagatgactgttgatatgtgtagcgcttcttacattcagaagggactcttgagtaatttaaacttctagatcccatgctccctgagggcaaaggccaggccagacttaactgtttcagttttgcatttctctgtctctcactctggcccttgtgcataggtgttcaataaatgtttgttggcattgttattaataaattcaccaggacaaaaacattataatttagatgttggaatgatattatctctcaaaaaacaaaatgtcaccagattgttttgccttgggagttctcacatctatttttttcttttttgtgtgtgtgagacagggtcttgccttgtcacccacgttggagtgtagtggtttgatcacagctcaactgcagcttccacctcccaggctcaagcgatcctcctgactcaccctctggagtagctgggattataggcacatgctatcatgcctggataatttttttaaagttttttttgtagagatatggtctctctatgttgcccaggctggtctcgaactcctgagctcaagcaatcttcctgccttggcctcccaaagtgtattttttaatatagtggattttattatatgtaaattatatacttcaatttaaaaagtcctatgcctttgggatcatatatagaaaattgtccattttctgagaagggtctctgccttcagtaggcagataaaccctgatcaaacatgcagaatcattaattagggtcatttgttctgctgtgagctgagaagaatgtgtaaaacctgctcaggagagaattaattcatcctcctctctgtactttttctagtactcctagcacgattctctaagcctgcaggcctcatacatatgttctaatgggctaattgttaaggcgacatttgtaaattaatctctgacttgagctaagtggtttctcctaatggctttaattcagtgactcccattgtcagattcactggaggagcttgttaaaaagaggtgcccagacttcccctcccccagctcatgatttgctggccctagggtgggatgagggcatctctgctttggaaggaaagctcctcaggtgactggattctggtggtagccacctttgtgagccttggctctgaatctgcctcccaaggccgtgaagcctcacacacccgctgaaagcatatgggcctaattgcagcaactccagtccaggttctagaacaggaaatatttctaagagccagctttcccgactcaatcacctctatactcacatcactgaatctgcctttttcctgaagtgctccatcacctgagggggaatagtctatgcttggctgtgctattgtccattttcatgaactttcatgaaccttgtcagacatttgaaagatcttcatggtccaccgggattttcatctagcgagatggctatggacttcccctctctcctccccattttgcaccaggctccttctttgcatcaggtgttagggacagatttttttttttttttttttgagatggagtctcactctgttgcccaggctggagtgcaatggcaccatctcggctaactgcaacctctgcctcccaagttcaagagattcttctgcctcatcctcctgagtagctgggaatacaggtgagcgccaccatgcctggctaactttttatatttttagtagagacagggtttcaccatattggccaggctggtctcgaactcctgacctcgtgatccccccacctcggcctcccaaagtgctgggattacaggtgtgagccaccatgcccagcccacttttatatttttttattttgctttttttggagacagagtctcacttcgttgtccaggctggagtgtagtggcatactcttggctcactgcaacctctgcctccagggttcaagtgattctcctgtttcaacttcccaagtagctgggactacaggtgtgcaccaccacaactgctaatttttgcattttttggtagagccagggtttcactgtgttggacaggctggtctagaactcctggcctcaagtgatccacctgtcatggcctcccaaagtgctgggattacaggcatgagccactgcaccctgcccttaaaaaaaaatacaccgtgtatgtgtgttcctggcattcttttgtgcaaacacatgtcttgtttgatcttggagttttgaaaatagatgactcaaacaccattgttccaatgacatttatcaaattgcttttgtttttaggaatctggcacaccgagtactcaatatctccacacagtatatgggtgttttcagtaaatctgagaaggtgacaattcatactgtccaagatggctgaggtaatttgttgagctcagactatggcaagtttagcaaccaggacaggctctcaagcaagctagcagaagtgccctaagaggcaatgctcaaattatctgtgtatcacactgctgcccccaagcccttgtgtgggacaatgctttgttacatgcttggttattgtcttattctatgactcagctgctgtagggcagggatgctttgctttctggggtactgtgctttccttggcctcattttaccatgtcccttgggcttctgtcctccttgtccctgaaactatagaagcttgcaaaaggattcccaatggcctcagcccttcgtgaagagatattagagtagtggtactatgtagaaaggaaggacattttgggaaaggagaggatattgagataagggccctactttttctatctttacccagttactaatgatccatctaggcaatagttcattttatattggctaaacctgtactatatgatttatcactaattgcataatagcatgggattaatctacagaagaatgactctataaaaaagagtatattttgccaggtgcagtggctcatgcctgtaatcccaacacttggggaggctgagccaggtggttcacttgaggtcaggagtttgagaccagcctggccaacatggtgaaaccccctctctactaaaaatacaaaaaattagccgggtatggtggcaggcacctgtagtcccagctacttgggaggctgaggcaagataattgcttgaacctgggaggcagaggttgcagtgaactgagatcgcgccactgcactccagcctgggcgacagaacgaggatctgtctaaaaaaaaaaaaaaaagagtatatttcatgactccaagtggcctcccatcttctgtttttcttgggccttatgtataggatatgttaaatacttaggtgactatttggggtgctctataataataccattaccatgcagactaaaatgtaatcattttgtgttttcaaacttagagttctcagacaatggggatttgttagagagatagagaaagagagagactaaactgacacttctaaggtggctttgctaggggcctagagaagacaagtctctgatggggattctattttcatggccacatccaaagtattgatgtgttttctgcagcacctggatctgggctgacaatgtgatcaagcctgacacgataaagaggcatttagcaagtttcaagactacgtgcacagttaccttaatactgagaggcagatcatctccccagggagcatttcatcgtacatcatggggcagtttgcctatcctgtatctcattgagaggaggccttccagctgaatacgtggacccaaatgcatgtccattcaacagagtcttcagggccagggagctgtggaggttatttccctcctggatttcttccctctcttaccctatcagagagatgctgatatttgagttttcatcttcagagggtagcaggattcctggcctcctcctgtcactggctgatttgcttaaataaggaatgcattagtccccatcactgactccaagtggaggcagctggagcaaattaggatcagctacattggccatctggatgctgcgaaatcattgccattgcaggggtcttagattttgagttccttacagaatgatgtagatgccatttgcaagggcttctttccagtccttttctgcaacagtggctttgggtggcataggcctatatagccagctctgacagatgctcagcattcacagatacacacacagggagccaaatggacagggattagtcttaaatcagctgtttatgaatggagaagaggcccttctcctgggttctggccacaccccttctctttgcagctttttgagaatgaggtcagggccaggatctaactgcttatgcctcagaaatagcagcacagatcaaaattaatcttaagctttttgttttgctgcctcctttagataatagaggaaaaagcgaaggcctgctcatgtttttgtttgcttgtttttgtgtgtacctttgaaaggaacatatgaatgaatatgtgtgatgggaggggttgaggtgaggcagctaagagggattagtgctgggcgggtgataattactgatagactgcagcattcaattggagcatgttttagttgtttttttttttaaatggcagaatgaaataaacctcagtggtgtattgttttagcacctccctttatatggagattttatcagttgctatgaaactgcatattccttttacagtgtccaattgtttttaatggtcattttctgggctgtgcaagccaccattctgccccaggagctccatgcagttttgcaatgctttaaatgagtatctcatgcagatttcattttctgtcagccactttggcacacataaaaaatacaggggtgtgtgtgtgtgtgggtgggtgtaaaagagagagattctgtctctcatacatacacaggcacacgtgcccgcacacacacacacacacacacacacacacacaaagcttgatcatgcttagtctttacataaattgggattcctctctacccaccagccaaggcctgagagatgtcaatagatggacactgaggagactgacttccaatgcccttcagcctgcagtctcttcagggtattagcatacctggaaaggttgacctagcagccaggcattgtgtgtaatggtggtgcttactttttattctcaggcttaattgttggctgaaagcatcttctttatttctgactatcctttatttgcattaatagtctcctctgtgaaagattaaagaaagtagaatgtgtactgaggacagaagtgtcagtgtcagcctaatctgctacatattcattctatggaccttagcatgacaggtatccactgaaggagatgccaaaactgtcttccatccatggagattaattttgagtgaagagtgtaaagtaggacaaggattgtcacataactggcctaatggattgcctaattgacttcctgaactggaactactttcctaaatatttcagaagtgttctaatcatatagatcatacatgcagtgaatatatctttatgtatgtccacacatacacacacggacatttgtacgagcaaatttgtgatcttcaaattggtatctcttatgtagtgacagaaagtagattagtgtggtctggggcttggaaatgggaaaggggattgatttaacaggcatgagggatcttactgggatgatgaaaatgttctgaaactggattacagtgatgattgcataacttagtagatttactaaagtcattgatgaattgtactttttaaatgggtgaatattgtggtatgtaaattatgcctcaatgaagctgttaaagttgatattcctctattggagttcctgcagatcctagactacatataatattaaaaattgtatcaccctaaattttcacctgcttttttcccactgaagtttatcaactacaattgcagagaagctggacttcgagataacagggtcagataaaaacccagtgccctgagacataaaaggctaccctgacccctattggcaaggagcgaggttgctgcccattgctgtatgaagagccaaacctgaagcagtaatggggggctggggatgagggtgagatttccaagcaggtccccaagggcaatgggcaccgtatttcaaagctgcttcggtatgtgtcaaaaaacccaaacatcctgaggtccaactcttaagtgatggcattctcctcttcttttacaggttgtcttagtctttgctctcagcatcggtgcacttgtaatatacttcatagattcatcaaagtgagtattcaaatatactttcttgccctcgtttcataaacaatcatgagcctttacattgatccatttatttaccttgacaccaacctttgcaagaccttctgagtgcagaagattttggaggaagctagtgctgtactgtactgattttctaaatgggaaagaaagttctcagaaggaaggctattttgagtctgctggcataggagggtgaggtatatgaggtcaagtcttcttgctgggtattacttatttttaaagagctgtttcctaatgatgtatttgcactgaagatgtcaagtagttaagatgacttgatgggaatttgcaacttctgggagggtgacagtttcccacagatgagggtctgagccattcttgctatggttgtaggatccttttctcaattgggtttccaatgctttgatcttactggaggtcagattagaaagcatgatgctatcctttcacctgccaatcgggtattcagctgaagcattgcacgctggtgcttcttgacttgtgaaggtaaggagatggatggaggagttcatcatgacccccagaggtggaggccctggccatttgaggacttctagagtggacactcatgcagactccttgggtgccagccgaatggactggtgctccagagtgagcctgggtgacagatgataaagaccttgcagaaggatgaagagggcacagactagaactgcaatgttgcagccagttctgccctgattcctgcaggtgccaaccctgaggaaataatttgttccaactatactattgcaaatcatgaagttgatggcatctgggaaacaagctggagtctaactcattttctgttgtggcgtgaacttggcaactctggtgacaatggccttgagcttgttgcctttattgtccactgtgtgagtgttttcaactttaaactctatccctggcatggttggctactagactttgatactaggaaacctgcttggtgtgcctgttggctcagactctggtgtgcctgaattctgagcttagtgctcctttcctgtggcttgggatggtggtaatttcatgcacagctaaactcagaatttctcagagccatctggtcaccggccaaggattttgtgcatttgggtggagaggccaaaatgtcagtcagggaaaacaaagcaaatatctcctttaataacctgtctctgggaatcagccaagtttaagcctatcagaggtccttcagcccaccccacatgcgaggctgggctgccctcacccatctcagatggagagtcctttaaacgctgtcaggagacaagattccacatgctccctccatcagctctcccgagccaagaaagagaagagcttgtttaagtttggaagactcccattggcatgtcattgaaggtaagcccccttttaaatatttactgttaatgattctggatcctatttgtattgaactgaagatcctctaaagcccctggtcttatttctccaatctctctccaggggtgttcttacatgtcgtggggtgcagaccctgccaacttccatgctgagactcaggaaagaggtttgggcttgaagcttgtatgtcccagagaaagaaaaccctaatgtggaggtgagtgtgttgatgggttagaagtccagatgcctcagccagcaccttccttcccttttcgtttttttattttttttatttttttaaccttttgtccctctgtatttctcagaaataaaatgctctttagatggatttggattgtgtctttttttacagtctactatgaggcagtcttttgttctgtagatcctggtgttctctgtttccgtgtgagaagatgaaaaggaatgaaattccccaatgcaccctcttcccctaatgtcctacaccatctcaatgtcctttggctttaattgtgatccttctaggccttggcgaagatggcactgggagtcctctctgattctggtttcttttatgaacttgcaaatagtctatcccaaggatggaacttcagtcctgtcctcaccttttcctggcaaaaatgcccataaggttagaaacaaggctattcccattctgcctgaggactgtcgtagcctcatcccagctttagcctttcttctctgttgctaaactgtgtgatttggcatagcaaggctttgtttataagaagaccttctggttatttatatagaaacttttcattttcatgacttcattttgttctgagagcatatccgaagattctgtccggtggcaggcccaatcagtggattcagcacaagggagttttccatcttccttgggaaagacggcaagcaagctcagttttagtttgggagagaattagtgtagaatctctaaagccatctctatggtaagtccatagatttccaggaataaaacacagtgaaacctattaaaaaattataatcgagcttagtgaatgagaaaaaaaaatgaagttctatccacatataagatgcaaatggaaagaaagtgagaaagtagaatgtacattcttaaaatccatgtctttcattcaaaactgttaccagttttacacattcatggtttggctggccatctgggtattttggaaagacagctttaaacttctcgtggaagttatactaaatcatcaccctggaaaaaaagcacccagaattctccagatgaattgtagctagtatttacacccttcaaataaatgaatcaggggacagtctataggctttcccacaagtgaatctaaaccaacagacatgcgtgaaatggcttgtctcagtgaattttagccagagctgcccctcccctccagaatgctgaggactatcctgtagcacaagtttgagattccaggctctctgcacccagccctttgaaaagtgcaaggaatgccgattaatgtataaaacaggctccctaggtctgctggaccagctatgtctcgaggcaggccagctccagttgtgcaagtggacaagcaggctaggtagttattttacttctgtccattagcaatacagctcagagaaaggtcatcattggtggtttatgatctttttaaccttttaaagctctttttactatccagaggtgatggataagtcacttccaaagacagctgcacacctttcatttttggccattaggcaaagacagatcccagcatagggcgttttctttgggtctgatcttaatgaacctagggtggttgtgagggaagactcatttgtgtagctgcaagtgattactatctggctaagacagattgtcctcagagctcctggaattgaaaaccaaagataattacgttaaaccttactaaaattatgctttatcatcccagcagtagactctctagaaacacccaagcagaggaagatgcctctggactgagtctttggtcagacatcatgttagtgccttaacaagcacagacaagcattgagccctccacacaccatctccccaaagatctccaattagccacacgaggtggattgtgtacaaaaagctccctttcttttgcattctttttaaaaggactcctgcccaatttatgtcacacgtcactttagttcctaattctgatgtctcccgacaccaacgccaaccctgtcctcccacatattctgatccttgtgaagcaaagattttttagaaattgtacaaccaagtcaagagtgcctgcagacgccctgtgggtgctaatgtcaccattgctgcttccatccttgtctatttcctccctttgacacaagaacagcaattcttatctaacagataaggaaaaaaaacaaagacccaccagtgtcagcatgagagcgagattcatggattgcataatgcagcagtccctgtagctttcagaatttcaagagaaagttggaagagacagaggcccagagctctgggtatttgcattttcaccaggggcattctgggaaaggatgactcacatgtgtgaagatatttattcctttgattcatgtttaaacgctgctacttcttatgctacggttacgcggattatgaatatttaatgtggcgtatactgaaaatgaaggtcaagtcctgctcactggtgacttcaatgcaggctcttgtctctgaaagggaagctacctgctgtttgcagagtaaagctgaaaggttatacgttgttaaatgtttccttaatgactttatctgctccaaaatggctggcacacaatgggggcacttgctgattttgccagtctttgctcttggcttctggtatcagcactgctgttttggggatatggacgttaggaaggagcaggaaatggcagcacaaattttgtagagcatctcatccaagggcacaattgccaaggcaacagtggggttacgattggaaaatggcctctccccagtcttttaaaatgttacttttgcatccactcacccatttattcattttgtattcatttattagtttgtaacatcttcaaatgtgataatgctgaatattttccaggcagtaaaattgcttatggttaaggaaaactatctttaagattgcgatagaaattgaccagattgttttcatagtctctgaaaataaaactggcaccattgatgtattggggatgtccagagctttagcagaactggtttagttgcccagtagtttctccctcccctgtcttcacatagcctggtctctcatcccttggcctagaaattctgtttcaaaagggaagagagggcaagtcgttggagggaactaacattcactgattatgtactgtctgtgagctacagagctaggcactttaccaaaaatagcacatgcaacctcattgaattcccctaacaacttcttaggataggtattactattcccacttacagatgaggaggctgaagctgcaggcatagcccaagctatgtagctagtaagcagtagagccaggattagattccagcatggctcattctaaagccatctctcttctaagtgtcaagaagtaaatttccagattgtgtaagtaactgatggggtttaatgagatgttgcaagaatgggaagttgcatcacctcatcctgccaatgcactggtcttgttttctcttttgttctccctttctccatttctcaccctgagaaccaagtgtgcagttgtgggtacgtaggaggctcctatcacaggccttccatgtaagacactgccctgggtcaggtgctgtctgatgtctgtttgggccttgattcagttcttcctaataatggcttgatgagaccagcttctctgttatctcagtggagtggcagcattttgcaatgagataggatcaaatgaacaaaaaacaaggagagctgattgttcctcattagcttccaccacctaggggtgtctttccaagtagaaagactctttggccttcctatccttacctaatctgtccttgtgatttggcatactgaaatagatatgagaaatgctgtttccccatgagatacattcttttatctcttttagagagttacagaattagttgatttgttatagttttgcattatgttatgcaatgtttatatgcccagagagttggtattatcaaactaatggacttcaggaaaatttggccccaaagaatggagccacataggatggaggtctttgaaatgtcataaagtatctggcttccttctccagccttgttcaaactgactaggcacaggtgtagacccactgcctctcctgtgctcagccccaagacaggcacctgggagagctgtgaggacagcacagatcccatcccattcatgacagcgcattttaaactgtaaaggactgtgtataccagctttcactatcccctttagtgtaccccatcctgcagcatgatgagatgggcagcctgtgacatggaaaaggaagctcaccagcctactctgtaaccagttcctttatggaatacagcctttctaggtagtgttctggaaaattagctccagctgtctgccttcatgcccttttttgagaagtcacggcatgcatttaacctttgttgaagaagtcaacacaaatcactgtgtgcaaagcacctccctgtttttttttttccttttaaaatactccccccagttttctccatccctcactgacatttttattgccaggctttggtttggaaaattatgggtagggaaagttcaagggcaggatgttcagaacggcactgcacatctgtgaagggaacacaacaggagagccagcagctgttgaaagaatggaatgtcagatggtagaggagccgagcccactcagggatggtggaagagaagatgccttcagggcaaagaggctgtaaataactccaatgggaagtccttgtctcccttcagaatgtaccctttaatagcaacacttggtgctctgatatgagagtaactctaactcagccttcctagctcatctgaccttccatattgccatttgttcaggaatcgagtgaaagcctggtagagaagacaggtggagagtatgccaaggaacagagtcaacttctttatatgtccttgtctccatataggtagattttggggacaggatctgttctttggttgtcaaacagattggtttcatttacgtcaaagttcagagcattagcacccttcctccttctcccttccacattggtgaggaaatcttgtcttccttgcttatttgtcattgcacaagtggtacctaggcatcgtaggcaatggcatctagaagcattaagggaactgcttatctttggctttcattggggaaatcagggactatgctaggaaaggacaggaggactgagctgaacctttcaggtctgccacaaaagacaactgtagaatatagtattagagtcaaagaggcattggatcccaactggtgccactgttctctgagcctcagcatcctttcctgaggaatgaggatgagggacctcctcaaggtcatccgaccagccaggggcagagctggagctggaagatagaacttttctctcccagtccttttctacttgatctcctgggttctttctactaaatacagaaatgaacaaagacatgataacctactcattgaatagcaaagtatatattgtctttttatgccaattctggacttctaggcccttatcatgggggaaactttagggccatgggaaagaacaaagataatcccaggtggaaaagatcaaatccagccaggtggctgcgtgggattagtttatttcatcctcactggtgagaggccttgaattccttgattttatgaccctcctactaatctctctctctccctccccactgtctccctctcttttttgtactgtttcagcatggagttggggatgggtaagagttaagagttcagctccactgtggaagggtaacacagggctgaacgcattgaagagctgaacacattgttttggcctgtttggaatttgttatgcataacttttgaggacattttgcccaattgctcacttgtttcccctgtggaaacactatctgataactatgtctatacatccctatctactttgccttccaaaattaggatgaattatttcttcccttctcgccactctccaaaacttaaaaagaatgctttggacaacctggcactctctcagccctctcttattctttttaaaagaataattgtttcagggcaaatgaagaaatgcattccctttcagacccactagcccactagttacttctgtcctctacaacaagcctgagtttataccgcaagagggctgcatctcctccctgtcacatggcactgggcctttccctatagtcacaggctgacatgcattcagagactgctgagagatcaggataggagccagctggagcgaaatgttatagctcagaacagtttaatccaaacacaagggcagtgcttgtgcctaacacaactgtggtaggggtgtggtgtggtgtgtggtgtgtggagtggtggcagcttttacagctttatcatggggttcatgggctggaggagatgtgaactcttccttgtcttttaccccttgtcttttgacctgacagcctgacacatgtagctttggggagaccctggttggtgatgagtcatttgtggcttaaaaatagaactctcaaagcaacaatgcccttgggactttttgatgcatatgtctttgttcatagaatttgggagaaaagagagagagggagagaaagactctgtgtgtgtgtgtgtgtgtgtgtgtgtgtgtgtgtgtgtgtaggaaacaattatgtcctgcctaaaaattaagtggagaagaagagcatgggggaattggccaccaggctcatcacagtagcagagatgaggctgagagctgtctgtgtacctgtggccttaaaggtaccaatcagataatagctctccactgagtacaaactgtgtataaggcattttgctaggtactggggaattttgagtacttatgtataatgctagatcttttccattaagacatttaaattatacatatttttacaaggggcaggaagtccagccatatataaaggaaaaataagataacaaaacaagaacaagtaaggcatcgctaagcaatatatcaatgactaatatgagcattgcacacagtaagtgctgaaggttgaggagttgaaaagatagctggatgctataacatgttttggctgtaggggagattttgagttgaatagacagaaaactcagtctgccctcaactctaggagtccacaagagaagactctcattatggcctgtactcgggctttgtgattttcagtatacgctaaagtcaagcaaaaccttgccttgaaatcagctactgagattagggattgagaatgcttcagggacggcataaaataatcagagaagcggactctatccagtggcagtaatacctgttgtccaatgatagatgattaaaacttttggaaatttttatttggaaatttccagaagcatctgaatggcatccactccatctttttgaaactgaggtcagtgtgcgacgtgctttgcaggggtcttgttacgaacttgccacatacagagcatcacaggggcatgatggggaggagagtctgcagtaaaatgagcttgtgctgctcgcaaacaggccacagtgtgggcatggttgttggcctgaagaccagcatttgcctccagctccgtgctgtgatttccatggactctaggtacgttggctttgttgagccaattcttccataagaatattaaatattatattttgcggctgcattggtataagaatgaatataatccaggctggatttattattgttgttattattactattatttttagagacacggtctcactctgtcacccaggctgaagtgtactgacatgatcatagctcactgtaaccttgacctctttggctcaagtgatccttcagtctcagtctcctgagtagttgggattacaggaatgcaccaccatggctggcaaattttttttttttctttgagacagggtctcactctgtttcccagactggagtgcagtggtgcaatcatggctcacaacaacctctgcctccagggctcaagtaatcttcctgccttagctttccgagtagctgggactacagctgggcaccatcatgcccagctaattaaaaaaaattattgtagagatgggggggtctcactgtgttgcccagactggttttaagctcctgtgctctagcaatcctcccacctcagcttcccaaagtgttggcattgcaggcgtgagccactgtgcccagcctggattcgttgttattattcgtcatttattattatatttattttcttctgattttaaagaagttaaaatttagacttttttgtgtcccataagtacagtggcctcaggcactgtgcctgcactgcctgctggagaaattgactttatttctccctttccaacagccccatccttctggaaattttcacagataagaaaacatgctcagagacagatgccttatactaaaccccttcaatgtggtctaattgtttcaaatgagaaaattaaaataagcattttattttaagccctgtctgataacttggctttgggaaataggaacttcagcaacccagcattcaaaacaatggatacaacaaaaattttaagacaacttaatagtcttgcttttctcccgagttttggaaaaacatgtgccttttccattcttttatctgacaatgagtcttactggtttaagagatctgttcgctgagagtgcaacagtacaaaataacatttttttcatctgatgtttgcaaattcatctggacagggaagggcagacattggaaatgagtgaggcggatctggtgaggactgcaatgagagctgaagcctcacctgaagtggcttcccaggtccagctgattgttcctatgcagaaatgcaggctctagtggccagatcttcctgtgtttcaaagaggagacagaatactgcattttatgttgaatctccaattttaaaatattggcctcaaatccaaaactcttaaagtacttgcaggccaagcaaaacacctctgcaggccagatttgggcctcctgttttcagcctctattctaaactgtctctctttctggtcttgaattggctgtgctccctgagtgccaggaaacgttcttaacccttgctcctccatctgccaaaaaggaccccttctctctctaagatgggaagcctttggtctcagggtgccccgggtcgtttgccatctaacacattttcaaacactgcttaaatttccatttttctcgaggcaaatactgtatgccacaccaataaatcatctacagcttactgtaagccccagagctacatatcactaactctacatcatctctgaaaataacgtcgttagaagctcataaacatacactctgtttgtttaagaactgcaagagcttttaaaacatggttgctaagtcacagggcatattttccaggacataaatggaagtgaacatatgccccttaaattgtcagattctttttttataagaagagaggcccaaatctgtctgttctgccaggatattaacttgaccaaagaagagttgattatactaagtgtgtaagtgttagtaattattggaaactatcctctgacttacttagctaaatgggcacattgtatgaaacttgatttagtttctagcatatgtaggtataaggtacaggttgacatggataaatcctggctttagttttcatgaaccctaaagttcacaatttgctgaactttgtatttaatatttactgatgaaattcttacggtgtcgtcccttccaaaacaaaatcggaggcatacttagacttttcccctgagacatggtcccaagtctaggctacaacttcatcactgaccctttttcatggaaatttggcagttagtgataggtagcgtctgagcttatagctcagatattttcaaagtaggaagtagatggccctattaatatcaactgccatttcagtagagctgcctcatcagtctcttttccccgtggaagacactcacaccaccttttacctatcaggacactctcaggaagaaatagtaggtagggctccaggacctctgatggtggaatctactagaatgcagttgtccttaacaaggatacctatctcatgttgctcatcacacccatgcagagacctgccaccttgtaatttgagagctggaatttccatacacccgctaccctcactccatgccagaaaatgcagaaaatgaacccatggcccagtttgagatacaattgatcttgaggccccagagagaactgcagggacagtgtgcagagaaggtgaaaataacgtggatgctattagatgactgtacctagcatgtgcttttcctctagcagtgggaggaagtggcacaggagtgcattaaggagtttgccctcttcataatagcatgagtagaaataataaggcaaggcctttaaagaacagcattaataattgaaaggtgctccaggcagccatgtggtcttccagtgcctttgagtacaatctgttatcaggtacgaggtgaggctgaggagtagacaaggagggtgcatttggcggctgtgtctgtgtgcatgcatgtgcttatgcttggaggaagtatgaataagatttggcagctacagcaagtaaaattatagaaggcaatgtatgtatattaccatgtagactggtggtggttcttttgtgggtcaaacacccatttgggaattggatgaaagctgcaaaaattttgcctgccaggtaccctatagttggtcaatgaaacccaaactaaggatttctattctcttaagatggattcatctgctcattcactcctgtttcttctgccatgaagatcaggtgactgccagagggccatcttcaaacccgaaggttaagcagaggttgactgggaacttttccctgcatgacatacaaaacatgtctaagtgaaagtctctgctgtgttttcccttcttgatcaagtgtcccttaacctgcaatgcattcaaaatctcaacaatgacaggtgatgctaaggaaactctgggagggaggccctgggcttcctacctcttcctccaataacagacaacactaaaaggggtaggtaagacaagatgcatctattaggccaagcctaagagctctttgatttgcttctcttgtgtattgtgggttagcacttgtttgtagaggacaaattcctctttaggcaatgattccaggatgcaaacaatctccagccaaaatcattccacccgagacccactgctgttgcaccaggaactagggaccactgggtacccaaacagatgcaaaagctgccacttctgtacaaggccgtatttctcaccctccattggagaggaagaggtgagtgtagagagtcgccagggatctctatgggctcatccaatcagtcttcagaccagtttgacagaaaacagaagaggagcttcagcacaaggaggcctcatctcatctgaattcccagcttccttcagatttcttcctgacctcacctgcctccaagccagccgactgtgacagtttaattggtgcagggaaggcgaggcagtggggaggcaggcaggggtgcctggcattctggaaggagactctcctgagatgagtgaggggaaccgcaacagacaggcctgagagcgctgccttcgggtagaaggtcacagagctttgcttgaaaagaatgctggctgaagaggaaacattgccaactccctcctctttgagcccactgggccagaattgtatattcatatttgtcatctgtgccctttccactctggggcaaaaaggtctgctgggcagctctggcggggaatgaaaatgggtgggaatgtagctgggcagggtggctcacatgaggtaagaggatcacttgagcccaggagttcaagaccagcctgggcaatgtagtgaggccctggaaaatgttttaaagattagctggtcatggtggtatgtgcctatagtctcagctactcaagagcctgaggtgggagcatggcttcagcacaggagtttgaggcagaagtgagccctggttgcaccactgtgttccagcctgagtgacagagtgagaccctgtctttaaaaaaacaattttgcaaaaagaaagtggggaggaaggagcctagtggtgaacaccagggtttggaatcagaccagaccttcttggcttacttggctctactactttgtagctgtcctgggcaagccagttaacctttccaagctatgaagtctttcctttgtcacatggggtgaaagtggtgatgagagatgtcatagtggataatacctacctgatagtagtgtgtggaaacaattagacactgcatggaaaggctcttagtacagtgcccagcttgaacatgaccaaaaaaagtattagatattattggtattgttctttttgaggtctgttttgaaacttttaatcaggtcttgagagagatgagatataaacacagtgaagttaagaaacaaaataagatgtattgtaaggcagtaaagagatcggttatcagaataatggacgagacctgtgcttctgaaaactgcaatctcaactcattcatggtttgtgaaaggaaaaacaagcatttaaaaaagatgacacagctgggcatggtggcttgtacctataatcccagctactcaggaggctgagtcaagagtatggcttgaggccaagagtttgagatcagcctgggaaacagagtgggaccttgtctctaaaagtacatacataaataaataaaacatgagattgatcagcccaagatggaaatatagctagagaagttcaatttgattttatgaaacttttgtttccattacatatatagatctatgtactgtataaatgtatatatactgtataaacgtatgtatactgtataaatgtactgatttgtgacgtaaactctgtttcttactgtggaatttgctaaaaagcgtttaagaaacactagcttttagtgtagaagccagcatacttgctggttgcagtaatccagggaactttaaggaaggatggcaggctagagttgggtcccaaggcatgggtagaatttggatgctgcagaagaggggcatggggtgagcagtccccaagaccatcctccctctgacatcaactgcaggtttggcacgttccccaagtcaccttcaggttcgataatgcataggactgcagagctcactgaaggctattatactcacggttacaatttattacagggaaaagatacagattaaaatcaaccaaaggacaaagtacataggccagagtctgggaaagatccaaatatggtgctttcattatctcctccatgtggagtcatggatcgtgttacctcccagcatcaatgtgtgactacacgcaaggagtactgtcaatcgagaaagttcgcccgggcctcggagttcaaagtttttactgggactggatcatgtaaacttgaatgactgccctcatggccagcctcagtcccctgctcccctggaggtggatggataccatgtaacccaaagcctccatcataaatgacattgttagactttctggcatggtcagcccctacccaaaataacactgttactatctggccagcccaagacccctggaaaagacacttttatcaggcatgacactccaagggcttagacattgcctcccagaagctcaggacaaggccaggcctctctttgggcaaagttaatgtctttacaaaaatagtcagtgaagggactttgttggctggaggagaggcctctcttgaggaaggctggaagtgggtcctttgatcacttgcatgaatagcagaggagaggaaaatgctactccatgaagtggatgcttccagattctactaatgtcaacaaaatccctgttgaaaacgaagcgatttattccttcccttggctcctctgcatacccgggctgaataacctgttagccagtaaggggaaaatgaggcacaggaaagaggaaaggggtcagcctggatgtatgcttgccatgtgggtgagtgaccttgggcataatggacctttggttagatctcatttgctgccacctccgggtgaccaggacttttcctgtgccttgtttctttgcagacctgatgaatggtcctctgtgtgcccgtgacaactttagtaaggagaatatctgtctccctgctccaatttaacttcctttctgtaaaacttgatgaggtcaaagccagaaagcactgaaacttcaagctggggatcaaaagcatgtcatccagccatgctgcccccttgcaacctggcaaatgagacaacctccagccagggacagtttataattgtgcaatcaaattaacttggatttcagcctaatgaagtccttaatgccctgaatgaggccaagccctaatatttagagaagcagactggaccccaggaaagaaaagaacaggcttcagttaatgcctgctagtattaattatgcttcttccaaaattcatcttctcgtaggaggcaacctgatagcacccagttctgctaaggggttttcctgctgtggctcataaggagaacagtggaaagaacattttattggaaatctctgctgaactctgcgttctgggccacatttcttaacttcacaggatcttagctttctcagttgaacaggaagaaaattcctcctctcttagaagtgttttattgtagttaaaaatcaatactctgaaggcaggtaggcttggttgcaaatcccaactctgtcatttgttagctatgtgaccttgagtgagaaattaacctctctgaggcttagttcccttaactgtaagtatggttaatgatattcttggttgttagtatggagaatagtgaatgagatactgtgcatcaagcacttaatacagcacataggacatgctggcatttattaaatctaatgatgatgatggcataaatgtaaaataattttcagtatggattacatgtcactaatttggtatcagtagtctttattttcattaagccaatgatttagctcttgtttagaaaattgctgctgattccgtaattaactcaataaatatttattgaatggctattatgtgcctgacactattttaagccctaagcacttacattccagtatcagaaagagacagaccgtaaacaagttgacaagtaaataagataaattcagttgatgccatgtgctgggaagaaaataaaactggtaatggaaaaagcagggtttcttaaatgttttgtgctgaggacttctttggcagtctggtgaagactatgacccctttctcagaaaaatattatttataaaggcataatataaaaacattggattataagaaaatagattatgttaaaatcagttatcagattataaaaaacaaattatgataaagtctgcttgcttcttgattagggcatttttatgaagatccagcaataattctaatataccaccatcattttaaagtaggattaatataagtaatactttgagatacctgtaacaattgtaatcttatatgtaaatatctgagatttctgttgctaaaaaaagttacaagtgtcattaatactgttctaatttattgtagaacacctgattctgtcactgttcggggtgccacttgtaacctgccatgatccctggtggactgaacaaagtggggctaactggggaataaaagtcaaagacaagagagtatatttggaagaaggggttgggggcacctcgcctctagtggacaagggccctgagctgtttcggtcctccgaatttattaggtaaaagagataacgagaaaggggcaggtggttgtcggccagcagtttgaatcacagcaggcttgcaagactgcattcttcaaacaataggcactagatttcccagtagataactttaaggagcccagcaaacctcctggcccttagcaaacctcctggaggcatgcgcagtcctgagtttgctcacattctgcattcacgataaacagtttgctgtttgatcatatagcctccagtggaatgctgagttggtcatgtcccatgggcctttggctccctacagtttattgctatattcataattaaaggaaatgccaaatttgaattagaggttaataaaaataaagatgtaatttttttggtccaaatcatggactccctgagtactgcacaaggacctcttggaagtatatggccccaagtgaagaatccttgggatagagaatgacttgtattgggcattaggctattactttagaaagagtaataatgcaatttccacttttaaacagtcattctggacatatagatcagtggaatagaattgagagtccagaaatacatccagtttttatagtcaactaatttttgagaataataccaagaccatttaatgaggaaagaatagtttttccaattaatgatgctgtccagtgtgggcaacatagtgagactctgtctctacaaatttcttttttaaacattagccaggtatggtggcacacgcttgtgaacccagctacttgagaggctgagatgagaggatcacttgagcctgagaggtggaggctgcagtgagttgtgattgtgccactgcactccagtctgggtgacagagtgagaccctgtctcaaaaaaaaaaaaaaaaatggtgctgggataactagataggcacatgcaaaataataaaattggactcttcacatcaattaactcaaaatagatcaaagatctacatgtgagagcaaaaacatttaaacttttaggagagaagacggggtagacctttgtgacattggatttagccatgaattcttaaatatgataccaaacacaaaagcaacaaaagaaaaagtagataaattggacctcatcaaaattaaaaacatttgtgtttcaatggaaggacattacaaagaaagtgaaatgacagcccagtttaaaaatggtcagtttatgaatacatctctctctaaagaagatatacaaatagtcaagaagcacatgaaaagatgttcaacaccttagtcatcagagaaatgcaaatcaaaaccatggtgagataccactttacacccatttggatggctatacttgaaaagacagatcataacaagtgttgacaaggatatggataaattgcaacccttgtggctgctcgtggggatgatgtagaatggtgctgtagctttggaaaacagcctggcaattcctgaaaaactgaaagacagagctaccatgacatgtacattccactcctaggtatttacccaacagaaatgaaaatacatgtccacacaaaacttgcgcttgaacattcataacagcgaaacaatctaaatgcccatcaacagatgactggattaacaaaatgtgatgtgcttatgcagtggaataccatttggctataaaaaggaatggagaactgaaacatgccacaacatatgtgtaccttgaaagcattatgctaagtggaagaaactagtcacaaaagatcacacagtatatgacttcacttgtgtaaaatgtcaagaataggcaaatatatagagtcagagaatagattactgactccttgcttgtggggagattgggggttgatagctgaaggctacagggcttctttttgaggtgatgaaagtgttttaaaattgattgtcccattgaattttaaacctcaaatgggtgaattgtatggtgtagaaactagaactcaataaagccattagcaaataatgactgtgatgtggagaatagagttcagggaaagacaaaagcaaggaaaatatttgggaggcagttttcttaggtctcaactgagaggatgctgccttgggagaggtccgaggccgttggggtgtgagcacatgctggaggcgtcacagacagagcagctgtttagttgaaaatggagaggaatcaagagtgactcttaggttgttgaccataacaggtattttcctcctagaaaagctgagcttcagttacaatctgcagaaatgctgggaggattagtggcaaacctaaaaaaaagaaaaacactagaagcttatcggagagttggtttgcaaagtttcactatcaatttcattgtaccttttagcagggaaaaatattcatcatacatgcacacaaatttacacacaacttcacatcttgaaaagcaacaatataaaactcacacgctttagaaagccaagccagggaagaaagaatgaaccccctgccttgtgacttctcatgctgatactcaatttgttcagtggaaacggatcagtgagtagagcaagtaggaaagaatctcttcaagaacttatgtatcttcgacatgtccatcacacataattttctcctagtcacatgtacaaatgataaaggagaggaaaatgtcatttcagggccttgagtatcacaggattttgataatgttagcaaaataatgggtaaaataactgatttctcaattaaagcccaagctaagtaacttgtcagcccaggtgtgttaaaatctgagttactctaggtccttctctagagacagtgtggcttcggtaatgagcaagctctggaaattaaagaagtaatcagatgttgattgaggttatctgcttcacttcaagcagaagcaaatcaagtggacttcccttgaagacagaaatttctctattgatagagctaagggtgtttcatgatgctgaattctttgtggctccttttcacataaaagtaggaagccattttccctggagtggaagggaggatgacttcccaggaatatgagctttgagccaaagaggcaggaactgggaggctctcagttacacttgagaaagaattatttctctcaatattgttcttcttttcctccagagccccagtgtgagcctgggtgcaagctctgataaattaattgacagagggttgatttctaaccccaacttcaccggcaaactttagctatgtaattccgcactggacagactgacagctcattttcctcatccacaaagaatgcagtgcaatagagaacttgtgaaatatcttctaactttaccactcttttgttttcttaatcctggcaaaattcacagagcataaaagtaactattagccattttaatgtgtacgatacagtggtgattcgtaccttcacaatgttatgcaaccatcacttctatttagtcaagacatttctgtaaacccaaaaggaaaccccatactcatcagagtcactccccattcctctgtcctcctaggccctgacaaccactgatctgctttctgtctctatggatttacctcttctagatgtttcatctaaatggaatcatatatttgcgacctttgtgtctggcttccttcattgacataatgctttcaaggttcatccacgttgtagcacgtatcagtacttaattccctttgatggctgaataatattccattttatgtctgccacacattttgtttatccattcatttgtcaatgaacatgtagattgtttctaccttttggctattgtgaataatgctccaataaacagttgtgcacaagtatctgtttgaattcctgttttcaattcttatatgcataggagtggaattgcagggtcatttaggaattcaatgtttagctttttgatgaatcactaaactattttccacaatggctgtaccattttacatttccaccaacaacatgcgggggttgcaatttgtccacatcctcgccaacttattttgtttttgtttgtttgctttgtgtgtgtgtacatatatatatatatatagccactactcccttggttcgtctcagggagtatgctccacctacagcggcagcttcagggatggccagcagcacaatgtgggaagagcacaggctttggactcagaccgaggtggggttcaaatccagatctccctcttcccaggaaggtagccttgggcaggtgataatctctgcaaatcttggtttctccatccatacaacagcaataatatactggggtgaagagatgagtgaagctcctggcacatgcctggcagacagtaggctgaacaaatgctcttcctcctcaattatggatagaaacagagaggaagagatggattttaaacaatctgcttttaaattattgttactactatttttggtattggacctcattatagaaagttttttttttttttttttttgccatgggcttctctgcaaaatcatgcctgattaaattaatacccaaattgcaatatgtttattctttagaccagtttatggggttaagggagatggatctgcatggtaaattgggaagatttactgagctaaccattgaactagagattcccaggtggatgacccacctttgtttgcttttccatcgtgtccatatttcagggtggacttgaagtagtcattgttcctcaagttccttcaagaacatggccttcttattcatcctagaaaacaaaaacctcttggccacaaactgctttgttagttttgtatacactgtgttacttgtgatggaagcacacattccctatgtaaaacttcagccacatctttcaaataacactaacaagttccagtgatgtcgtattcatgctgaattattcttttcttggtcccaagcaaagtaggttttcacgtagtgagtgctgaggatacctccccttagggttggcgcccatggtagtgagggctttggaccaatgccacatgactacaggtggctcaagctggaatttctgttcactgaatgtggtgaataatgagggagggaaagagcaaagcagtagccgggagagtgtttacactcagtgccccagttagctcagagcatggtaggccaagaagacacttgggcaggctcataattttatgtgccttcaaattgatatttgttacgtaagtattcaatatttatttagcagagaaactaacctttgtgttggggaagcggaggaggaagaaaactgttgtagaggtggctcagggaccctggcaagcctctttagcagttcagagactctttgtttatctctgatcttgtccttatgggagctttacctcctcacacctggctttttatagtgctcttctcgatcatgtatagtgagtgctcaccctgaaaatctcatttttccatcttgttacttttccagtgatctcctggggactttatagattggctaccaggaaaccgagtggttggcttaccccctaattcatctctggctgagagttttctaaaagatattttaaattaggccgggtgtggtggctcacgcctgtaatcccagcactttgggaggccgaggcaagtggatcacctgaggtcaggagttcgaaaccagcctggccaacatggtgaaaccccgtctctacgaaaaatataaaaattagccaggcgtggtggcacgtgcctgtaatcccagctactcaggaggctgaagcaggagaatcacttgaaccctggaggtggaggttccagtgagccaagattgcgccactgcactccagtctgggcgacaagaacaaaactccgtctcaaaaaaaaaaaaaaaaattaaattaaatgcttgctttttggcaggcgctgtggcccttgtaagtatcacctcatttaatcctcataacatcttacagggtaggtagcagtattacccccttcttacagatgagaagaccaaggcacagagaggctaaagtatcttgcttaaagtgacagctgggaagtggcagaagtactcccaaatggctaatagaaattagccattttatgtgaacaattcagttcaaatggagcattttatcccagaactttaccgttaatgcctgcatttggcttgggcaaaatagcataacacttctttccaaaatagtcaggatttcagacccctgataatgacagagaaatgaaagcagtttgaggacagttttatcttaaagcatcatatgtgctaaacctggtgatttatttctgagttaagattggtataataatgaagtactaatgaagtactaatatccataatataaatatttctgggaactggtgggagctacccatctacaaaggtggttctgttttatttggttcccagggagtatagcattgatgtcataatttgcatctggcagtaccttctgagtcactggttaatgccaaaacatgagaatgatggagccctgaaattcattagcttcttctggggcttggtgaacctcaaaaccagaacctgggtttaatcagacattcagtaaggaaagtgatcaattgcttttcctatctgtaactaattgtatttttaaaaaagcagggaacttaatggggaaaaattttccctcttctgcttttctccatgagcctcaaattgctagatattctgtttccagggtgttgatgtcagtggaaatggcatgcacagaatcattatctactatgccacaagctccatgctatggtctggcaaagaaaagactgccccaggcaaaggggaagtcagcttatataaaaaagcaataagcttttccttaattgctccctaagaaggaggattctggcatttaagatgagctaaaagtacaaaaagaacatgttttgtaatgaaggaggcacacctccctcaaagacccctacaactactcttctggtttttggctattagtaaaatagagactgaacaatctcccattgtgcactcaggagtatgtggctgtcccggtagccccctcctcttttacctgaagcccctcagagcagttatgattgattccacttctcttctgaaagcatcaagtcctgggctgggcaaaggaaagatgaatgactcccatggctctgttgtagattacttagtgccagttgtcagttcttttctccctgggaagggtttgaaatgagattgttttcgacaggctatccatgataaatgattttccgagtaagaaattgctttcactgctgaacttcaccaaatcactctgacaaatgtttgtggctgcagggggccttctcgtggctgtctcatgcttgaggggtgggaggctgggatctcaaaccaggatggctcaaataggacgtctcccagtgaagacagaaagagacaggaatgtcgtctcgttaatgtgcatttggtcagctcctttcaactgctgctaaaaatcaacaagtgaggcccaaaatattccagatccaagaaaaataggtaggctaaagggatgtatacatctcttagttctgattattacattgttttcatgttggttataaatagaacagcaatatgtacctacagcaagggcaagaaccctcccagcaatgttgcaatgtttgcaacctgttattagtccatgacccttcctgaaaaatcataaaagcagcatgccctcttttaatattatttggcatttcaaaagagattaaataccatgtctaaaatcacaaaggactgttagaatttgccttttccagctgcataaagtcccccttcctcccctagattctgggagaatagggccttctgcaatcacagacacatgtcacttggcaacaggggcccccagggcattgacgggaagatgcctcctaagcttggatctgcggcctttgtgggtagcatcattggattgtttactcagag[450 bp omitted]ggggagtcccctggggcaggtggagaaagatgagtcatgtttcacctctccacctgttcttgctgaaatgataccccatctttctagtagttcctgcctttgtttagacacacagatggccagactgaagcccaagaggaaatggatgtgctcaagacaacccagttggtgagcttcaatgccagtcttttttgctgtaatgcccagtctcccctggccattctcacattgctcagtttctctctggccagtgtgcctgcccgttgacattctgccctctttcagaacattgcaggggaggagtctgtaaggtaaccatcaccaagtcaagctgtatatagtccagcattgccaactggattcgctttattcattcactcataaaacattttgagccttttctgcaccatgctctgtgctgggtgctgggaccatagaagtaaacagaaaaagtttcccaccttcaaggggctcctggtctcacatggtatctgacaagtgggagcagcggcgccaacaacagcatgggaagtatgttgagtgcttactattctagtccacgttctaagcattttctttatattagctcttctgagccttacccaagtctgtgagatgggtgctgtcatcatcgacatttgatggatgaggacattagggtgcagattaactaagtagctcccacagagtcacatagggaatgggtgacacctccaagatctgaatcccagaaactctggctttggggatagatgctctgagttggcactgcaatgggagtgagtcaagggcagggatggtcagcacttcagcagggtaaggaagagctgccggaaggagctggtgcctgagtggggtcctgagtgttcccaaggtgtcctggttttcagttttggtgagaagcagcctggctttcctgagctctgggctgggtctttgggagctgggattgtcctgcagcccctttcttgtagtgtaaagactgtcatagaaaaggcaagttcatcagggtcctgcctttgcatccagggggcttgagagctatactgaaaagaggagaagatgtgaaatccacgtgctcagctccatcctcaaaactccacttctaaagtcactcatttgggactgaaagttttttagaaactgttcagaaggaatgtggctcctctcccagtctggggctatgggccatgggcctaggtcacaccttgctgatcaggacagaaactggaataaatgactctctattttgggagcagacacatgtaaggctaattaggtctgctgaaccccaggtgtatcagggtctgtggaactgtaccatcccagatagggagcaaatatggcaaagtgagaaggcagaagcagcagttgagaatggctgactcatgggcagcacctcttccctggcctgacttcagcagggggcagatggcagaggcgtggcagagcaagcaatctgagccctcctgtagctgctgggtccatgctggaagaggctcctctgttctggaacttctctcgtggcagttggatattttaagtcatgaaggcttccatatacttagcagatctctgactcattgggctgtttgattccttgcgtgaaccagtaccaccaagacttcacttttgtcttcacttcgtccatgacctctaccagatccaagcacaccctccttgaaactgtgctatctgcaaccgtgcggtgtaaagaagtcatctgtggttagaggacagtgccccacaattgaggaaggaaaaaaggcatgccaatcagagagggcaaaacactcacatttgagaaaatgaacttgtgttctagtaagctccatcgctctgaccctcccggcttctgagttttctgtcaccatgtctgtctgtatgtccaatcaagactgtatcccatcttggatgtcatgggattctcattttttattcattctagatacactctgattattctgcactttcttttcaacttgtttgggggacaaacagcttttatagctggggagtgaggttgataataaagactttaaagacaaaaatacagatgtgcaggttaactgagcaggaccaagatgagcaggtggctgggttaatgtcatctgaaaagccaatacactgtgtgtcacaacatggtctgagcaaaaactacaaccactatgaatggcttccaaattaaaattctttttttttttttctgagatggaaacttgctctgtcacccagagctggagtgcaatggcatgatctcagcgcactgcaacccctgcctcccgggttcaagcaattctcctgcctcagcctcccgagtagctgggactacaggtgcctgccaccatgcccggttaagtttttgtatttttagtagagacggggtttcaccatgttggccaggctggtctcgaactcctgaccttgtgatctgcctgcctcagcctcccaaagtgctgagattacatgtgtgagctaccacgcccagccccaaattaaaattctttatagccaaagagaaatgatataatgatttcaatgcagttaaactctgcagtagcatgccccacaatacaatcataatataaaatcagatatgtagagaatggcaatcagcttcaatcctctgcctgtctcagataataaagctaaagttcttttttctgggagtgaggcaaccttgccatgagaaatagaaatgcaaaggtggggtcctcttggcctgcgttctgttggcctgttctctggaatcaggaatctagcccatacaacaggagcagattaatcgacttcaggatgtttttgaagtcattgatgctgttctggaagtcccaacagccaaaggatctagaagcctctaattgatatttaccccagagcagcgaactgacccaggtagaacctgaaaatattgggatcttgcagaaggactgcagacatctggctatgcgggcttcctgaggtcatttcagtgcccttactgtggtgcaacttcacattgtacatgattgaaatgtttaggctttgcttatcacattatgttgggagtagtaggtagagacagtaggagaatagagggttagaggcttattttaaatcagattgggcatgtcactataagatctataaaaaggtttataatctaatatgatgctcataaagagtgctcttccaatctgattcttatggatttcccaggggtgatcccaatctgattgtctttgtagtacagtgaccttcatctttagcaaagccagaaatgcagttcccaaagatgggagagcagcgtctctactcctgagcctagatctgcctttttttctctctcttgtagggaggattttcattttgccctttctatgtacaaatgctttgtgctttctcgtattattttgtatagtcacccaataatcctgtactgaaggagttatgatcaccattttacagatgatgaaataggctcagagaatttgacatttgtctaaattcatgcagctcgtaagtgacagagctgggatttgaacctgcatctgtctggctcctaagcctgggctgtctcactctgcatcataaatattccttgtgatgcagtgtttaggtgggtacagtctagtcctttaatgcttaatgctgttttagggggttggggagaacatagactttcttgagaatttgatgaaaattggacctcttgggtgggcagggagccaggaagtaccctaccctcacaattttttgtttgtttttaatttttaatttttgcgggtatatagcaagtgtatatatctgtggcatacatgacctgttttgatacaggcacttattatgtaataatcacatcatggagaatggggtatccatcccctagagcacttatcgtttgtgttgcaaacaatccaattacactcttgcagttaattttaaaaggtacaattaagttactattgactatagtcaccctcttgtgctatcaaatagtaggtcttattcattctttctgattttttttgcacccacccccacaattttgcatataatttcagctagctcatggggtccctgaagcgcatctatggattatttaggcctagggcagtccttggatcccaggttaagctaattagggtcttgggaagattcattaaatttttttagagaaaaagcttgagtgattagaaggtcatttccagaaatttccttttggctcttcaggaataaagagactgggtgaggagagaggaggatggtgaggggaagaggaactggatggaagacatgaagaaattagcaagcagtaaaagcaatttgcatttgtgaataattaaggttgttaagaccctacggacttggctaacgcaccattcactagcagtttcttttcaggttaaaattaattggagtgttggtttatttatcttttcccttggtgaatcaaatgactcatcctgatttataaaccttccacctatccactctctattaagacctgtgggggctagcgattgataattttattgagttccccagggacattatttgtagaacccagttgctaatggttaggtcagtgaccgctagagacatctcagaaccccagaagctctggtttctatgaaaagagaaaacagccccaacagttggatgtcacttatatcttgaggcagactttttttagcagaaactggaatatatggctaagggggtaaaaaggaccagatccaagagcttggggatttttagatttcaaaactagatagtttcaaactccccaggaaaggaagagagggctactaaaacaatctcctccccttttgtctagaaaagaccccttgaaaccactattagaatggcccctttgtatgcacaaaaacgacccagattttcttcttatcacttatctgctctcctagaagttttaaaatctcctgacatttaaaaaataaatgacaaggaaatgtttttcccagcctagctctgagaaaggcagtacatccatcccagaccctgctgccagccgttggagccactgcagaggaaatctgaccccatgaacatctaagcaggccgcagagcacatggctgcccctgtggctctagattctgaccacatggagtagactcaaactccagccttaaccagtggtgtgactttgagcaaatcagcctagcagtaaaagcacagctttggtgtcaagctgcccaagttcaagttctgcctaattactcaccagctaagtgatcttatttcacctcttccctgtgcctcagtttcttcatttgtaatatgaagacaacataaatagtaacacaaaaagggtgttatgaggattaattgagtcaacagataaaaacactcagaacagtgcctggtatgtgtagtgggctagaagggcacccttcatgaattttagttattattattatttaagctctctaagtttcaaggtctccacttgtagaatggagctgataatggggattttatgaggataatgagaagatacacttaagttcttagaaaacaatgccactgggcagagcatgactgctcagccagtgttcggcaatcatgagttaccatgttagtgatgagaaacaaaccagtagtcttcttacagttcctatatggattaagacttgaggttgctaaattagccaggtgtggtggtgggtgcctgtagtcccagctacttgggaggctgaggcaagagaattgcttgaacccgggaggcagagcttgcagtgagccaagatcgcgccactgcactccagcctgggcgacagagcaaaactccatctcaaaaacaaaacaaaacaaaacgaacaacaacaacaaaggacatttgaggtttctgagaaatcatatggtgggtggagactttaaaacactgatctttctttactttctgtaccctcataatctttggcactaactgcagctgctgggtttagggctcagggaaaagccaccacccctcttagaacccaagaccccaggctggtatggatatggaatgtacacgtctctcttcttccccactccgctagtttaagcagagtgagcctgagtgcctgagtcctatgtctattaactttttgttgtcagctccactggtaatagtgcttcaaagaaatgaacgtcttaggatccttcttagaagcatgtcgtcacgattgtattaagctgatggaaagcagaacaataacaacaacaacaaaaacaacattcctttctaagccctgtggtctaaagggtaaagtgaatttattaagcatgtctgtgaagcaaaagctctggaggcatggctgctgtgctgattctctgggaaagtggtgatatggagtcatatttgtcactagacgaaatgaaccaggagggcacttcaagaacagaggatctgaaagaatttgggctagctctaaaaaatttattaaataataaaaaaaataaggccaggcgcagtagcttatgcctgtaatcccagcactttgggaggccgaggcgggcagatcacttgaggccaacagtttgagatcagcctggccaacatgatgaaatcccatctctacccaaaaaacaaaaattagccggatatggtggcgtgcacctgtgatcccagctacttgtgaggctgaggcaggagaatcacttgaacccaggaagcggaggttgcagtgagccgagattgcaccactgcactccagcctggtcgatggagtgagactctgtctcaataaataaataaatcagtaaataaataaatccaacagtctcatatattttgaaatgagaccacattaaagaaaggatgctcttgggatcatggatatttgcgggctctacatgggattgggtgagtcgtgtggtggtgacccttagctcagaggagacttctactggggtgcaagtgaaaatgcctgcaggagccaggctggatgcaaggcttaagaagtagtggggaccaggagacacgtcttcaggagcatctacccagctccagtgagttattccccagtgggaatatggagcatgtcttgcagatcttttattcattcaagtaattctgcaaatccattttaagaaatgtaacacttgatttttaaaacctgtatggttttaaatggtttaaatggtttaaatggtttaaatggcctgtatgggtggccattttgtaacctttggctatggaagaccagggagctagtgacgttgtaatttgcaaggaggccatgggagtcatttggaaatggagtgctggactccttcaacttctccctccctctcaactgtcaagagagaagggttcagggcttttggttacccaggggagatacttatctcctctgaacttccccacccacgcaaataatctccttcaatagtggtcctagaattccatccctgagaaggatcttctcaaccctcccattatgttgagatatatatttaaagtattatggaaatggctattataaatggcatagatagtttatatttttaagcctttgtaaagcattttggtctcatgacattcctgcacatcaagaatccctggtggttatcgaacttttatgtgcaggtaggctccccttgagaagaataacaagtaaattcaaaagagaggctgagaatcaactattctcagcacaaataaatttttctgattacaaaagtttccatcacaatgcttttgttgaatttatgatagggtttagttcataaatcaatttgatctacacataattttcaagaaagcatctgcagcataaattgaggtgcaactgcacttcataccactttttttctccttttgtttctcattttccactttgttctgtctgtgtcatctgtaagtatctccatgttttcattcggcagctcctggagacttcatggcaaaccaacatattgaatgcaggaaattccagggtggccaagaatattctccagaaatgtactgtaattcctattcctttaatacataccagttgatgttgggagaagttggccatgtgagaagtaaggcctgagatgatgggattgatgggcatctacatctctaaagctgacagaggaaacatttggcttagaaaaaaatttagtttttttttgtttgtttgtttagtttctttttttttttttgagacagagtcacccaggttggagtgcagtggcatgatctcagctcactgcaatctccaccttctaggttcaagcgattctcctgcctcagcctcccgagtaggtgggaccacaggcacctgccaccatgcctagctaatttttgtatttttagtagagatgggatttcatcatgttggccaagctggtctcaatctcctgacctcaggtgatccgcccgcctcagcctcccaaagtgctgggattaaaagcgtgagcgattaagattgcacctggccaaaaattcagtttttgctcacaaggtttctgcatctgaactgttcattcataacacagggacagagcagagacctggagacatggcttaggatcctggctgtgccacttaagaactatgggacctttctgtagcccacacccttatctataaaatgaggaatataatgtttatcttgaagggtagttgttgaagattaaatgaatgatgtgcacagagtcaaaaccatatataaagccaatatccagcttataatactcatttgataaaattttttcttatgaatgaatgagttcatggttaataaattatctttaaagaagtaattcaaatttagaagccttcagaagctggtacctagatctgacaacagctacgtgtactgtattttactaattctaagatacaattttttcatagtttaaaatctccaaaatcaggaagtgtctcatcattcatgacttcttatggctataattggtaaatattttctttcttggtggcatataaagcagtggcttacttttttgttggtggcaacttagattccatagactaactcagctaggttaactaatttgagctgctgctgtttgccttctcttcctcccgcttctctcacccttccttcccacttctcctcttccccccttcttcttcatagttttattgaaatatgttttatataccatagaattcactcatttaaagtggtttctagtatagtcacagatttgtgcaactatcgctgcaatctaattccagaaaattttcaacacccccgaaagaaaccctatatcaattggcaatcattccacattctcccagtcccccagtcttctcagccctaggcaactactcatctactttctgtctctatagagttgcctgttctagacatttcatataaattgaattttgtaatatgtggctttttgtgacttccttctttcaattagcatgatgttttcaagatagaaatagaggctaagaagtctaagatcaaggcaacagcatggtcaatttctggtgagggctctcttccagggttgcagatggccaccttcttgctgtgtcctcacacggcagagagagagagagagagagagaggagagaggagagaggagagagagagagacaggtgggggggaggggcaagctcactgctcactggtatctgttcttacaaggacattaatcccatcataaggccccactcttatgatgacctcattagacctaattatctcccaaaggctccacctccaaatgccataacactggggactggggcttcaacatatgaattttgggggaatgcaatccagttcatagcacatcaagatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacaaaacaaaacaaaacaggtgcaatctgtaatcatgttcagaagataaagaaaagaccatcccgacagaagagggcactggcctgatctagtggggtggtgaagtagggaaattaaagaggagaaagacattttggacaggactccatgatgaattggatgtggagtgaatggaaggaggaatcagggtccttctagccttctagtgtttggcttcaatgacaagtcgctggtggtagcatttactgggaagggaggggctgcactgggggctaagggctgcactagggagaaatcaggatttccatcttggatatgttcagtttaagaagtctgtgacacctgaaagagaagatgtcaaacagcagggtagataattgagtccagaactcagaagagaggaatcatattacatttggaaattacaaagatgactttgaatgcctgtgagttgatggtaccatctggggaaagagtgtagggagaggagagaaggtgccccaggtgaaggcaagaggatgcccaacatttagagggtgagtaaagcaggaggaggctggatgggaaactgaggaagggcacacacagggcaaggagatggcagaagcctagggaggagagggtttcaggcagagggagtggccaattgccaagcactgttgagacagagggaaggtaagggtctagggtcatctgtggagtttgtgacagggatgttgctggtttctttgacattgaagctctagtgagtggagggagggcctgatcaaagtgggctaaaggatggagcctgcagtagtctctggaaatgtggttggctatggaggacagttgagcaagcttatattttggcagcagagctccagcagcaagggagagcttgctatagcaacacagtacagttagacagtacagggctgaaagagtgtctgtggagggcatggtgtgttatgaatgaagaggcagaggatgtgctgggcgcctgtaagtgcagtgttggagagctgctggtaggaaaaaaagtgtaactggcctgattcttttatgtgacttttaatgacatgatgaggcgaggccatccactgagcctgatggtgcagaaaagaacatgggaggttggaggagagaaggaaaactgtgaaatagtggccttggaaaattggaaagcaaaccaattcaagaaaaatagcagtttgccagtcagtatggagtgtcaatttgcagtttgagatcatgaatttaaagcgaaaccagtcatttcccttgtgtggttttattcaggaactttcagctttccagagctggtgtgaagtagggctgagggcttctgttatggaaggagggtgctgcccaggggtgatgacaatggtggactatgggaattaggctggacaaggagcgttgcaaggcaaggcagggagcagatgactggccaggggtgggatgtcgggggaggtgtccagaatttggagatttctctgaggttggggaagggtcccagtggggagcacgtgaacaggcgagcacaaggatgagaggttgctgttgatgaatggggtgtttgaggccgagatatcagaaacactatagttgctgctttcttcgggtccagagcaagatcatgggagtgggtgggtggcgtggaggaaaggaaagggtcaccgacaatcagcagagcaaggacctgggaggccagcacttctggtggttggtctatgtcctggtgattaagatgactggagttggggtggagagggcagactgagagctgggagctatgtcccaggccataatcactaggcccacttgtaattgtgtgtgtgatcaccagacattctccaaccctaactttttgtctcctgattacagtttcaaacttaaaactgacatgcaggagtgactgtttcagaaatgtgagtccatctcttgctgctcctttctgtctaagggctgattgtattggtgatttggttcttggagatgtgagtgctcctgccctcatgaggaccttccttagacctcgcctactgcctttgattcctgtggagtataaaagtcaaaggatacattagggggataaggatgataagcaagtccaagtataggtgctgaaagctactttccaggtctccaactttagctgtgctccattcagccagggttagagccgtttttgctcgttgcagagtaccctgtgaatgttatacatcataattgtatcattacacgtcataacaataggatttcaactgttattattgcacattctaattatgtaattactcagtctttcaccgattatgtaattagatttaattacaccaattgcagaaataaacgatagtcaactacaaattacttaaaaaaaaaatccagaactatgcatacgtcggcaattgtcccaaaaataagaatagaaaacataaggaagggaagaaggcttacgaaaccaattagcaagtgaaaggaatgatgtgatttggatagatctttaaggataatggcagggaatcatcttgtctagaagtttcctgtcattttttttctctgacgaagtgtggtagtaggaattgaagatgtcaaagtcaagagcgctgattcctcttggctgtgccttgaagcagagattgctctcatttccttaaccatacagcttaatgaggaagagggaagagaagacagcaagagagagaaaagagcaagagacactgagcaggggagggagagaaggagagagagagaatataacaaattggcatttcataattaaaagtagtatacatacagtacttttaaaaatatatatttttaatttcagtttttattttagatacagggggtacatatgcaggtttgttatgtgaatatattgcacccaggtagcgagcatagtacccaataggtagtttttcaacccacggtcctttccctcccctctctagtagtccatagtatatattgttcccatgtttatgtccatgtgtgctcagtgctcagctcccacttataagtgagaacacgcagtgtttggttttctgtttttgtgttaatttgcttaggattatggcctccagctccattcccgttaccacaaaagacttgatttcacccttttttatggctttttaatattccatgatgtgtatgtaccacattttctttatttagtccaccattgatgggcacctaggttgattcaatgtatttgctactgtgaaatttcatggcaatgagcatgtaggtgcatgtgtttttttggtataattatctagtttcctttgggtatatacccagtagtgggattgttgggttgaatggtagctctgatttaagtgttttgagaaatttccaaactgctttccacattggctgaacaaatttacattcccaccaacagtgtgtaaacattcccttttctccgcagccttgccagcatctgttgttttttgattttttagtaatagccattctaactggtgtgagacggtatctcattgtggtttaaatttgaatttctctgacgattagtgatgatgagcagtttttcatgtttgttagccacttgtatgtcttcttttgagaagtgtcatttcatgtcttttgtccattttttagtgggattatttgcttgtcaatttttttaagttccttatagatcctagttattagacctttgtcagatgcatagtttgcgaatattttctcccattctataggttgtctttttactttgttgatagtttcttttgctgtgcaaaagctctttagtttaattaggtcccacttgtcaatttttgtttttgttatagttgcttttaggaacttagtaaaaaattctttgccaaggctgatgttgagatgggtatttcctaggttttcttcaaagattttatagtttgaggtcttctatttaaatctttaatccattttgagttaatttttgtacatggtgaaaggtaagagtccagtttcattcttctacgtatggttagccagttatacccacaccatttatttaatagagagtcccttccccactgcttgtttttgtcagccttgttgaaaatcagatggctctagatgtgcggctttatttctgtgttctctgttcagtcccactgatctatatgtctgttttttttaccaataccatgctgttttggttactgtagccttatagtatatttgaagtcaggtagtttgatgcctccagctttgttggtagtttgatgcctccagctttgtttttttgtttttgtttttgttgtttagaattgctttggccactcaggctcttttatggagtcatatgaactttagaatagttttttctaattctgtgaagaatgttattggtagtttgataggaatagtgttgaatctgtaaattgctttaggtagtatggccattttaacaatattcagtcttcctatccatgagcatgaaatgtttttccatttatttgtgttgtctctgacttctttcagcagtgttttgtagttctccacatagagatctttcacttccttttttagctgtgctcctaggtattttattttctgtgtggctattgtcaatgggactgtgttcttgatttgactctcagcatggatgttgttggtgtgtagaaatgctactgatttttgtacattgattttgtattctgaaaccttgctaaaatcattgatcagttataacagccttttataagaatctttagggttttctaagtaaagagtaatattatcagtgaagagaggtagtttgacttcttcttttcctatttggttgccttttctttctttctcttgcctggttgctctggctaggacttgcaatgccatattgaataggagtaatgagagcgggagtctttgctttgttcctcttctcaaggggaatgcttgtagctttgcccattcagtataatgttggttgtgggtttgtcatagatggtttttattattttgaggtatgttcctttgatgcttactcttttcagagtttctatcatgaagggatgttagatttaatcaaaatctttttctgaggctattgagatgatcatgtgtttttgcttttaattctgtttataatgctaatcgcatttattgatttgcatatactgaaccaaccttgcatcccagggataaagcctacttggtttgtggtgaattaactttttgatgtgccactggatttgatttgccagtattttattgaggatttttgcatctatgttcatcagggatattggcctaatgtttttctttttttgttgtgtctctgccatcttctggtataaagatgatgctggcttcatagaatgcatcagggaggagcccttcctcctcagtgttttggcatagttgcagtaggattggtaccagttccttgcacatctggtagaatttggttgtgaacccatctggtccaggacttttttttttttttttggttggtaggttttttttaaattactgattccatttcagagcttgttattggtctgttcaggttttcactttcttcctggttcaatcttgggaggttgtgtgtttccaggaatttatctatctcctctagatttcctaatttatgtgcatagaggtattcataatagtcttcgagaatcttttgtaattctgtgggatcagttgtaatgtcatctgtgtcatttctgattgcacttatttgaatcttctttttttgttaatctggccagctgtctagcattcttgtatattctttcgaagagccaactcttggtttctttgatatgttatatgaaaaaaggtagtacaatatattttaatgtggagaacagagtccatgttaaggttcaaatttatgattctcccttggattagtttcctaaaccccttttgagtttgttatctgaacctagaacttcagagccagtactctatcatgttctgttccagcaaaatttgcaagaccaaaaattaataggtgagaaaccaagaatttggtacatgaataaatgtcatactctattgtttttcttttccattacctcaggttattgggtagctttgatctgaggtgcctataagaattcaattagggctgtgtcacaggtgtgaccattttttttcctatgaagacattgtagagggtggtctttttctggagaacaggttttctctgttgtaactcctagaggtaagaaaagaacagtgatagctcccctaggctgagttcactcagctgcctctgtgcctggagaaaggactaacccagagcttctagagaggagaggcgaagagacagctctgtggaggcgggaatgtgcacacatctgggagagtgggcatgctacacttgcactcttccaaagagagataattggtaggtgccatttaagcatatatatacttaggagaaattacccactgagcttggccaagtactgcataaccatagaacaccagcattgctcagcatgttccccaggatcttacagcagttgacaggatgaggattacttcataagaacacataatagttggtgcatgtacttacactgctataaaaataggtcttgatgctatagagggtcacattggggaatcagtgtatttgtttagctcttgcctgtgcatgaaaaactaatagtctgcaataacacaaataaggaaaaaatgtagttttaaatatagaataaagccattttattttgagcttttctactgtatgtttgtctatggaatcccataagatggacagtagatgctaaagaactttaatctagacatattcatctctcctttggtttatgcatagctccaggattgcatttgatttttttgctgttcatgggctttcatttctgcgcacaggtttttaaaacgttttatttacttattatttatttttagagacaaggtcttgctatgttgcccaggctggagttgtgtgatcataacttactgcagtctcaaacttctgggctcaagtgatcgtcccgcctcagcctccaaggagccgggattataagcatgtgccaccatgcctggctctgcatacaggtttaatgcctgttgaggtcaacccacagcagtggaaggtggcccctagaatagagtagtgctcttacattgggcatttgagcaaacaaaccctgggaaattggaactaagagaagggaatcaagctggaagtttgtagcccaaatattcattctcatctacaaaaatccaccagaacaaataaggttaagctgatgcgtatccgcagatttgcaacagtgtggcattccactctctacttttcttgtcagaaactgagaatgtgtaaaatggaagatgtggcgatatcaagcagccaaagctattttccaaatgaggacaaaagaagtgcggccagtttacacaaagcaagcgaacttgctgagcagttataatctgcattccagattctcagcccagagccatcattcctggcttgctcttctaaacagaaatgtcaatgcaaagattaaagtggattgtagtgaggtagaaagttgtcagcagggactaacatcagagtcttacaaaggcattttacctagttaagcatttatggtatgcacgcaattttggccatcacaggctcaaggagagggattctacaaaatacatcacatcagtataggaagggccacacaacctgaacagacattagcgaggaagacaaggaaaggctgtcatgcagttagtcaccagtagcagccgttcactcagtggatctctaccagatgttcaataggtcaggtactggcttgcctggctatcattaggggattctgatcttagttctagtttgctctctctaggtctacaagcagcttctgtatttattgagtacttactaggtgcaaagtgccatgataagccttttacaaacttattattctacttagtagcactactacgattttctttatttgcttgatgaagaaagaacacctcagaaggtttcaatgtccacatggttagtaataggaactagagtttgaacccctggtctgaatccagagtccattttcttaacctctaaattatgcaatgtgttatattccaatatctatagaatgcagaacaattttgtcattgtaaagatactttaagtgtggaattaaagtttgtttagggagagtcctctattaaatttatgtaatcagaagagctttagattaacatgggacaagactattaatttcttcttcacataatctagaaaaaaaaattgacaagaaaatgttccattttgccttcaaatgaaagcggaaatatgtggttaagtgtaagtcaaaaattagatgtcaaacatctttccaggtgcatatattatataatattaaattgtcaaggaactccttgtgttggaatgcaagagaggaaaatcctttttgtgagtacaaaaaaatcatatagacataggaagtgaggtgggagcagcctgatcctaataacaagcatggtttgataaaggaaacactagcaaactagtattgaccatagacttaatcttagtgagaatgaactaagacccgcccccccctccctccctgcctccctttattccttcctttggctctccatttatttatttacttgtttagcaaagtttattgagtacttagtctgtgtcaggcacttgtgtaggttttggtgaaacagtgaacaaaacacacatgttttctgcttttatgggccttgcattccagtggagatggccaaaaacttggacagttgaagaaacagaaagaagatgagtatggttagagctcagtgggaaagagagagagtaatacgggtggtaggagacttacgtagaggcaagaggtccagttcccagttagacgaaaaaccaagagcagatagaagtttggcgcatgactttacatttgacaacaggtaacagttaatgagcccttaatcagtgccagtgactgtctaagcccttgtcctgttttaactcatttaaactccacaacaccactcaatgaattcttaaacatatctactaaatagaaaaacaatgaatccaacgtcaggttgacacatttttttcaaactcttttattgatttaacagtgagttagaacacaatgagattaattaaacctctttttttcagttttaaaaatggtgatgctgtattaatttaattgtcttagcacttataattttttaactgagaaaaagtattttgtatgtaaagagattgttcttaagctttaaattaaacaaatgttctctcgccttatggggaaatgggcttatttgcaaatggacccactcaatggttttattttgttctgttcacaccatactgtcatgttgtccatagattcattagagcgagattggtgcattaattcattccattattctgttgctcataataaacaaataatacagttttacatcactgcttctatactattagctcatatagttacaaatagtctttgtagaattgcctacccagaggtgtcacttcagaagctagtgataactctacaaatttttacaatttcatagacttttaaaaagtcgtcctgattttttaaaaaatggttttatatttagggagagtgatgactagaaggagcaggttatcaaaatctaggctgatatgagaggacaaattcaaaggaaagttaatgttaagtgatttaaatacttggttcagatggacttcctaatggaatcttcatcatatatgcagcatggagtaaaaactataagaaaccttcatcaatctaagactgcattaaaaattactatattttttgaaggtttaaatatattcagccttactggaaaaattagagcatgttgatttatatccagtaagataagttactctccaaggagaccctttgggttaaaatcctcacccacactcctcttcatctatgtattcttatgtggagattttaattcatctttttccattgttgcttgaacacctgattccttgggttggcttcctggagaaatgaatcagcaagagaaacatgagctgacttcctcctatttgatatgcacacatctctagatttttagctttgctcctagtatgcttcgtgtcaagtttaggtccagcttcctgagctagagcacaaaaaaatatatcatttgaagcaaagagagaagaacgaactggggcttcaatcacctctgtgtattatttctgatatagaaccaataagtttgtgtgcccactgcatagtaacagacccattaccctgagacagcaggtttgcagcagagaagggtttaactatctcagggcaccaagggaggagatgggaggagagcctcaaattcatctttctgaggagctctgggctgtggtttttaagaacatcatggagcgtgatgggctggaaaattggggttgttgactgatcaggggaagggggattaaatcatcagaatgtggaaattgtgttctttggtgagtcagcttcttgtggtgttcctcagaccttcctggggtcacccgtggggtctttcattcagatcagctgatgtagtagtttcactcgtatgcaggacctgaaagactacctcacggggaaagcttaacatttcttaatgttcaagttgttatctatagagcacttaaggggaactatcatcttatcacagagtctacatgattctaggacaataggcaccaaaccatgtcgaggaagcaggtcagagaatgagttgacctcatgcttaatgctgaatgtgcttcaagcttggtttattaatttattttttcccctttcttcttccctgattaattttataatgtttacaggggcaacttcatttcaatcttggtttcccagttatagaagataaccctcatagaaggagaaaagtgcatactcattagtttcagaggaatgacttttttttagttttaggcatttagattttgtgatgcctaatgacacagaaattgaatgccctcggggagactctcctgtggaattttaactatcccatagccttctcaggtcttggacctctcatggctagtgaggtcaaatggctttgctgagtggtgaatcttgttacctccaaggtcattcccattcttcttcttgcacacatgaggtgagataacctgaaactcccctgaaacacgggaagagcacacaaatcagtcctttgaatgcacctcatcctctagggattgtagtaatattgtaactgatgtaattgtcatataatttaagttcttttttctttctttcttttttttttttttcctgagagggagtctcactgtgtcccccaggctggaatgcagtgatgtgatcttggcttgctgcaacttccacctcatggattcaagtgattctcctgactcagtctcccaagtagctgggattataggaacccgccaccatgcccagctaatttttgtattctattagagatgaggtttcactatgttggccagactggtctcggattcctgacttcaagtgatctgcccgcctcagcctcccaaagtgctgggattacaggtgtgagccatcacgcctagcctaatttaagttctgaattggtatgggactatggggccatttgaaaccatgttgggagatgggacttccctagtatcttggtactgttgaattataatcagtttcctccaggtttgtctattttctccctcaattcatttatttttctcctcctccttaaacatgtattgagggcctattttgcgggtaccatgatgatgggaacccagacacaaaacaccaaggctctcccctcaggagctcacagtctagcagggaagggagacagatacacaaacaaataaattaccacttcatgagtgatgagcgccacaacagaagcacccaggaagaaaagcctagaaaaaggttcagttacctctgggtgggaggaggatcaggggaggctttctggaggaggcagccactgagttgagtgttcaaaggtggatgagtaagagcttgcaagggaatagcatgggtgtgaaacagaggagtgaatgcagcagcccgtccattcttagctgctgttcattcttacagatgtcaaatatttctgggagtcttctgtcttccactgttacaaaacttctttaaaaattgttgtgattaggataggacccttcttcatagcaggagtttcccagttctttggggaatgctttgaaaaattcatttgttcccggattgagctgttctagttgtttatcctttaaacagcaagaaaaagatggtacttccagacttcttaaaagcccaagccacttgcaggtaataacggtgtcaggttaacagcagtgacacatcttctatttcaggaaggattgaattggctcttcctggatattcatttgctgaggcttcaattccaggagattttattctttgcacatttctctgttttctttttgttcctgttagaggcagcttctcagaatgataaaaactgttgacatgttccttgcaaagtctttggcattctaaggatccatccttattgcctcatttggccttgactttacttccaatataattgcccatgacaacttattttagtagagagtgtggtagatggccatccttgggtgagtttgagggtgctgtaaatactcctatactccaaaacatctcttctaacttgcaaagtacctgaaattccaccaattagacattcattcttgaagccttttcagttgtttcttaaaatctaagtagctcttagtgtcaccctgcaccttcattaagcaggtatcacttgttggctcctcagtgtggtgagcactgagttctgggaaggacaaaacagggactgaaaaactaaggaaaaggatggcttagcctgcaccaactgtacgtgaaggaagagagtcattatcacatcagttgcattattcagcacagcttgttacctgatatctgcttacctgaagagattactgtgggttaattctagaagcttgcttattacattaacgacctacatttattgacagctgattatcttgggggattgtctctgagaatttgtgcagtaggtaaatgatgtctttgcctcaattagcactcctttgagaaaggaactaagatagttaatgttgatttgtatcactgtggtttcttatccctcttttatatcttttggaattgaacacagtattatacctataacaggtgctgagtaaatgtttgttaaagaaatcagtctgtagacatttagaggcacatatcaccagaaatagaccactagcctgatgtctggctacagtaaaaccaaacaggagaataactgttttttaaaattagaacttcattttgaaatagtttaagattcacaagaagttgcaaaaacaggacagagtttctgtatcctttccaagctttccccatgatagtgctatatgctacataggcatgcatggtatgttatcaaaaccaggaaattgatattggcgtactgctgtaaactcaagtacagatgttttgccagtttttacaagcacttttttttttttgctgtgtagatccaagacattttatcccacataaatttgttttattacctctccagtcagtatacagaactcttccatcagcacaatgaaattctcttgtgagaaaccaaattttaaaaagaaaaagaaataacttaaaaataagcaccaacatttttataaggtcacatgcgtgaactttaaaataatactaatttcaggctgggtgcggtgcctcacgcctgtaatcccagcacttaggcctgttctactctcctttgaaatgaggtccttccccagcatgccttcctgctgagcaattgctgcctggagcatctccctgagtgtctgctgtgcagcaaggtggctgccactttagggaatctcagcctgtgctccttttccaagttcagtgtgtattgtcttctccgtaagtccatgtatagagggttctttttccctgtgttagcatttgtacacttggcctggcttcatggaaactccaaactagaatggacttggaacaaatggaaatccaccaaacaaatatgaccgcatggtcacagcagcacacagacagaactttcctgtttctgatttaccaacatagggtacagagctcccaccacggttaaaattgagctaagtgagtatcaaacacacttggtcactttttaaagagaaagcacattacctgaaaatggcatctttcctcttgtcaactcctgccaaaagaaagcctcaccccctaccccctgcacaccccagaattcatactttcaggcagccctctggaaactaaggacatctaaatctaaaggtcaggattctgtgagagaaaaccagtccaacatgctcatgaaatcctaactgtgcacagggttggatggacacttaaaaggcagttaagttgatggcttgacggtatgactaaccaagttctttaggtaattaatagtggatgcagcagaagtgttcactgtaatttttctatgtgcctgggtgtgatcacatgtatacaatttgtctataatctgttatctgtaatttgtctataattgttggcatgtgtctactatgtccaggtacccctatttgaggtactgaaatatgttcattttatgtcgattctaactataatttagagactgctctccaaatagcagaaagaacagcttcttactagggtgggtttttttttttccagaagattaagagacatgtgctgtcatttcttcatgacacagattcctgcaatagacatgggggccgtggtaggagagagaaccatgtggtttaggaaattgcttcagtgatactgtggacctaatcccctcttcctaaagaactctgacagcagcaggccctgaagaaggggtatttcccaggatattaagatactgtaattatatggcaacaatgatgctcatcttagtatgtgcataggttacttttttccgtggggatttaatttgactaattgacctctgtcttcacaaccttctgcttccaattcctactctatattgtccccagaattaacttgctacaagacaagataatggtaccactctccagcatttaaatttctatcaggctgggcgtggtggctcacacttgtaatcccagcactttgggaggccaagacaggtggatcacctgaggtcaggagttcgagaccagcctagccaacatggtgaaaccctatctctaccaaaaatacaaaaattagccagccatggtggcaggcgcctgtagtcccagctacttgggaggctgaggcaggagaatcgcttgaacctgggaggcagaggttgcagagagccaagatcgcaccactgcactccagcctgggtgacagagtgaaactctgtctcaaaaactagatttaataaaaataaaaaataaataaacttctgtcagctccctatttcctataggataaagagcagacatgcttccagggcacacagatgcttcaccgtctcctgtctggccttgtttcttgccaaccttacaatctacttaggctctatacgaggtgtccttccactcccagaatgcactgtgttctctgtgcttctgtctctctgcccaagcttagccctctgcttccatcccttcccctgccttctcacgctgatgagtttctaatcctcactcaaggcctactgcaaaagttaggcagaggcgatcttctgcttccagagtcctttgcttcttacttatatttgagtactactgatcataatagctaccactgacatagcatccatcatgtgctggccactaacaaagcagttcacgtttactaactcatttatttctctcaacaacctcaggaggtaggtattatttgcattttataaatgaggacactgaggcacagcatgattaaatatcttatccaaggtcatacaaggtaatcagtagaatttttaaacaagctgctcttgcatatctgctgccagaaattaaaatctgggtagacttctctgctaaatggaaaactactccagagcaagaatcatgtcttattgaattatatgtctccaaaaccagcatagtgcctgtcaccaaagaaaaaaactcagagacatttgttgaatgaatgtacagactattatgtttttgttcaaaaagataatcctttgaaaagatgtcattcaactaagcctctgagtttttaatctataagagagaataaattgtgatcaagtggaaacagctgcatctcaaggaatgaggaaggtagtgtcgggaggaatcctgtgttttgcttctacctgcattcactcccatgttctgggtggtgctcaagtttcagtgggtatgttaaggtctcactgagtgtggaaagtgaggcagtgcactgctcattcacactggacctaagttccctatcaaggcctccatcatacacgcagggaatcagaaggctgaactcctggagaacattttagaaggagtaatttataagcacggggcttgctcttcccctgtcagaactaggaggcaggaattgtgagttaggactagaccgtaccattttttgagttgtgttcaatgtaccagagatcataaaaggcagaagaggcaagaaaaatgataacaagccttatattaagcagggagtttacaggaaactagtttttagatatccagtgtagccttgacattagagcgaagcttgatgaatctctactgaatttaaaacagtattattactcctttaagagaaatgttaagaaatatatatatatatatatatatatatatatcacatatatatgctttttgctgatgaattgattttgataagaaatacctttgagaatcttgctcgtaactagggttctgctaaatggtcaatatgtatgaggtgagctcactgttcacctgtcattcatgctgagatgaagaaaagatggcttcacttgagagcgtggttaacttcagggttataaatggctttcaggggtatagatgcatagagtccctacccttgcaccacccgagctttcacgactgttgggttccttcaacactacattacgccttgagagtcatcatgagctctgtaaccaaagtgttaaggatgttggcacttaactgtctcttatttatctgacccgcttcagctctgcttctataatgaactgtaactacaggaaaccatggtgtgtatctttatgtaactgatgccttgtttctcctgaattttcacaacatcttaacaattatggttgatgttaaaaactctcatgaggttatttgttgaagtgaaatacattataaaaatacatgcatatgaaaggatggccagggaagccatttcattgagtaacggccagttctgtcctcaccttccctctgtctcgcccctcctcgtccccaaagctgcctcttctcgcgtgtaatgccagcgctctgtacagtgttctgtttagagtggtttgaacatttttctgcctgtgtctctcattgctgaagtaactcacctctctcatatcgactcttacccaggagccgcactgcagactctttgatgtaggtcctttctgcatggcagctaaggccaagctgtggttttcatttgcatgatgcaacctccccctttcggttgtcgcctccaggttaaccagattcttttcctgcactgcccaagcatgttgacgtgctttccccgatggccctgaacgtggtgagcactggacgcatgcatgaattaaagcagcgagcattccaatacactgaagcactgggcctgaggcttctcctggatcatccctgtgggccctcagtttgctgtgatatcacaaaggccaccatgtcccttgaaaattcaagactaggacattggaaaagagagagataaatctcccgtttttaggtttatgctgagcaaagactaatgacaaataattagaagctaggaccagttttccaagtaacaacctacctgatcatcagtcctacatgttcctgactccacctgggtgtgcaccaagtgaccaggatgatgataccctttcatgtctttctgaataatgttacctgatttgattttgcttagatctaacaaatatctaaataaaaagatataccttttaaaagcacttcttgggctaaatgcctcaggaaatgcaattattgatcgttttcatagtgtttagtaaaactattaattcaactttaaaagaaatgaaatggtactactaggaagaaatatcgcatttgttaaagcatgttggcactgcattcaacatcattgattagtaaattgtgatcattttctctccttgaaatattttttttttgccttagggctgtctaatgacttactttaaaactgctttcttttccttattttttttaaacttgtatacttctttcttgtattctcagaatggacttttataaaacacaactgtcaggatctgttttctcactgcatttctttttttgtcatttcaaatagatactttgcattttagacatgccttggttgtaagctgagaaaaatgaaaggcgaggcattccaagctgtgataatcctagggtaggaataacagttcctagacaattcttgatgatactagcttgtcagcatcccttagcccaagagtaggcactaagcagtcagaatgaaacaaagccgaatgcttcttatcttatttttaggttttcttcatgaaatctgatcttctacaatctgggggcttagtagattgaagctcttcccacagtcctttttcctcctattctattaaccatatcccatgtattatattgaaatggactttgcttagaatttcataacatgttcttttggtaaccagtaaaaagatcctttgaatgggagcatttcgctttttgaaaggagcttaaatgtaattacagtacagacctgtgcaggcaggcgatcctgcccagcacgttggcatattctcactttatgaacgttttcatctgggggcttggcgaaggaaacatctgattctcttttgtgagattcttcagtacagagacccattcctctttcccagaaaaacacagtgattcctcataaaatgaaaggatttctgaagcccaacagaaagtggggatacagagatccattcacagagacagaagagaaaatcctaagaaatcggcttcctggggccatcctaggcctctcacagagatgtttttataatgataggaataacatctctagagaagttcaaagataggacaataaaattaaaagaagggcctgcaggaggaagcaaggagaaagacacttcaccccactgagcaggtaattcatcatatttctttccaaatttatacccaaaaatctagtggatgtcattgatatggtggaaatagctatttattattatttttctttttttgagacagtctcactccgttgcccaggctggagtgcagtggtatgatcttggctcactgcaacctctaccacccgagttcaaaccattctcctgcctcagcctcccgagtagctgggactacaggtgttcaccaccactcccagctaatttttgtattttcagtggaggtggggtttcaccatgttggccaggctggtctcgaactcctgactttaagtgatccacctgcctcggcctcccaaagtgctgggattacaggcttgagccaccatactcagccagctatttattatttctgaaacatgggcaggggaaacctaattttgataaataaatgattttcaatgttaattagaagcaagaaggaaagaaaaaaaaaggaaaagaaatgttccaggagatgagacattactttcatgaagttgtcaagaaggaaatgaaaagtgtgcatacttgaagatatgattgtataatcataggggttaataagtcattgccattttccctattaatgatgacagtttgttttaaaggtaactcatcctgtctgattttccatggtggtgttggtttctactgcccaggtcctttatgacattcctaaggagtgactctagccttgtactcagcagacccatgacttctaatcagcagcatctcagacactccgttttggctgtgaggctgctaggctctcaacaaaactcctaaataggaaaacttacaaaacttccaggccttagctgtcagccaaagacggagctaagacacagctattttatttccttgtgcaataaaggtataattgtcttctatgccagatgtcagaaagacttctaccaggtctttctctgtgtgttcttaaaaaaaatcctcaacaacaacaacaacaataacaacaacaacaacaacaaaacttcaagatgttagaaatagatataagccattataattatccttcagcatcacatataaattcatgtgtaactttaaacaagctggtgtccttgtggtgactatctatgttatgtgacattgttttctgttcgtcaaagtgaagcagcagataaatggaacaactgttttttaaacataattatttttttttccagatgttctcaggcttcctacattcaggatcagcaagtcttcagcattggtactctttgttagtgtagaccttgagtgccctgctgaggggcttgtgtgccattctgcttgagtgcagatgtgccaagaggtacaagagttggaactgtaatagacctcttaggctactggctgaaatactaaggttcagaataagaaagagatacgtctcaggcatctcattatccgcaactgtcagtccggaactcagaacaggctggttctagctgtcgattcaatagttttagcttctgtactccaaatccttacaggtagacccatagcaaggtgccattgccagggtcatgccatccaggtatgacaggactatgtcaaagccaggtaggagggcaagaaaagggagtataaggcataagttaaataggggactggtgagatgaccaggggaggcccaaagagtccaaggcaaacatctggagaaggctcagacagaattttgaagtctgcatctagtaacagcccaaagaagtcccacagtgatttgacagtctgttatgctatgggagtaccagcctacctgcccaaccgtgccctgattggccagcctttggcaaatagagagctcttcttttctcttaggagcctctgccatcccctgtatgaatatgagggcttcttatttgggaagccttgatatgaagtgccttgaaactgtaccctgagctactttctctaggatgccctctctttcagaaatgtgagctccaggctgttgctccccaatggctaggggttgttggctatccctggttatagattattgtttatcagcctcctagcacataggtggcaattttaatatccagaaaaaaaaggcataggaagcagaatgtagtggttacatgaatagtctattcttgtttccctaggactaaattcctgtagatgtgagaggagtatggatccaggggtcagaggttccattccccatgccagcatttgtgtctagattctcagctctccattcagacctgggacttctcttctctttcctttcccccatttctaatcacctcatctaggctgtcctgttttgtgagtggtcccagagtggggttggggttggatggagagcatatatttgtgctgggaggctggggatgtttgtgtgtacacgttgtgtgggtgcccacccacatgaaccactccatacctatacatggctcattgaccctgccctcgaagaactttcactctgtcttctggtatatgtgcataagtgcatatgcatttagtgctatttgaatcacctactccatcccattccttttctagataaataagggttccctaaaaaaaagggatggctagaatcagtggagggagtggaacgagtgagtagaattggtcagtcatgattcctaagacagtttagtgaaaactaaaatcaagcaatacttgtttggaaagactctgttttatgtagtagcttagctctgatttattacatagaagttgctggcaaatatgaacactaattctactctggtaacaactgtgattgaaataattgtagtctgcagataagctggagaaaacaagcattagtgggtaggttgtcttggacatcattccaaaagtgtaacagtgaaaaagtacgtgctcttagagaagaaaacttacaagagatatttacaagacatatgactggttcagatctctgcctcttatgtagatccgtgctaagccaaccaggcaaggaaagctctcatctctaaaaaaaaaaactaggaaaaaaggagaataacaaactcctgtggccactcattaaagtgacttatggctttctctgtcaagaaatcttggctaattatttagcatttatgagactgtgtggctgccttcatggaaatataattttcactttttcttctttaatactctatagaattatactaggcatttgtgaaatcttacagtagcccaatgcacagcctgttgggcatttggattacagtgcaacaccagataaagaggcagtaaagcagatacaaatgaaaaaaatagaaacaattgatcctatcagtttttgttcagttgaatgattgccttttgggggcattttctacaaacagttactattatcactattattattaccttagttttggaaattactatcacttttgagtgctgagtcatctgattcagtcttagaacaacgttgggaattcgtaaccttatccccagtttacagaagagaaaacaaagacttgaagaggtcaaattatttgcttaagatcctatagctaggaggtgatagggctggaactttagctcttccattgaattctaaaactacctagctgccaaccacttttgaggtcaacttgtaatgcccgtattttgcttttgctatacctatctaggtctatcgtggataagaaatatggaatgaagatgggaaaggagactcttagttcagatataatattgaagtcttgttagataaaatttaaaagaacttcataacaaacaaaagggttctcgccacctgagtttcttgaaagcaaatgatctgtgtgtgttttattgagaaatttataaagaattgacatattccattctctctgttagcaatctatgtcattttctttgtctcctagaagaatgttttactcttaggaataattattcaggtagacatcctgagccttacaactgctctgaagtcaactgctatcattgtttcaggagtctccatattactcaaagctcaagaatacagagtgtatatggatgctaaagagttgttagggtttttatactactttccggtatgctccaattcatttcaacatggaatacatatatttgtggctattggatcacatctcttcaactgagcagagctataattagaagcctgctgccatcaaaaggattaatagtcctgttgatacaaacccataactgatgacttcccagtaaagccagttaaacaaccagctggcatgggatcataatcgatcagtactgcagagtaacaaaaactgttttctatttacattagagtcatttcaaggtctaagaaaaatgttttaagattaaaaaaggggggcccattttgatgttatcatcattactattgatggatgattgaccacaaactgacccatcaaaggtgaccacatcttagaagataactattccatgatgtctgggataaagtgaagaggctttattctgtttggtaaaactaaaaactacacaacttattgaacacacatgccccgtccagtgtaaacatgagaagaatcgatattagaaagataaactcttaggtacacagctctgataagataagtaaaatggcagcatgaagaaaaccaaaagaatacaaagctttcagcttggatcccatcaggttcagggcagtcttggggtgttgtcccaagttcaggagaaaatgttctatataaatattattgctttctcaatgatgaattcatatcatgtcattcacactaaatccattattgttattagctcacaaaatatttttctgtgatcttaaattttatgaataataatatcagtttctaatttgaagtacattgcaaagacttgcctccttttaaaattagtctgtctcataatattctggctggctagatgcttttattccagtgtaggcagtttatccaggatatccagaggtagccaggaaagcttcaaatcacttagacctactctcttggttatagatagattccataaaaatccatatccatatgatatcatcttttttatttattttgattggatcaaatgggatgcaaagcttattaatcatctagttcataattaagagtcttcagagtgtctaagtattatcagctttcattatcttcatccttgttctcctagaataggagagggtgagggaaaattgggccacttgaagggtcattcatctttaatcagttggataactaggagttatccctctataagcagaagaacttcccctcagccgatgggatcagtcttcctgataccaccaccccacacggggtcccagagaggacttctggggattattagtgtcccacatgacagtctctacagagcagggttagggttaggtacaggttgaatacatctgcttcctctgcattttcctagaccacccaacagacacatcagttattttctagggcagtttgtcctcctctatgaaggatttatgaatcagtcaacccccatcatttttgcatgagccccaggcgaggctctgtagatagcagacactatgtcttatgcttcctcttcctctccaagaaggctgcactccatctggagaggaagtggtatggcacaaggctagtgggtctctatcctaactctaccacatagctgcagggtcttgattggatatctgagcctctgcttctctgtctgtaaaatggggattatagtacaatatctactttattctgccattttgtgaggaccaaatgcaatagcatatgtaaattttatacaattgtcaggtattattacattgaattgaagaataattgaatatgaacataatgaggcagtttagaatttttttcctcccagtagcatgggaattcagagatgggagaggtcaatgagggcacaagtagtttgctgaatcaagcctggaggttggcctcgaagactgcccaaggtttgaacacaaagagtaatcagcagttgaagaggccacagagaaggcatagatttaaaattagggaatacatgggtcacattcatgaaataatgaaggcaagggtttggactgaaacatagtagaaaataaagtaagagatgtagaatgagtttaggttttagaaattcttcctagccaggcttagagttactatatgaaacaggcagggaccgtgatggtggatgaatgacatttttaattaaattaatttggcaacattgcagaggtgagactaggaaaagagtctagaatcattaggcttattgcattgactcatgtctgtggtgctgtgggcctgaactctgcctgtccataatcctggtgggaattgagagggccccattcaatttagaaagggactagccacaagagtgaggagaatttgaacgttggaaattatttcacaaaatgatatcttgttcctcagccagtcccgtccctagtaaatcatcttgggtgtgtgttattgttgttgtcattcttaagctacttaccatttctttatcccttgtaaatgatggtctccgtaacccctccccatctgtacttcatcatttttccttttaatcttaatctaaaatgtgctcagcaggtactctctgattgttaattggaacgtccactggtgaagcttgcacagtggcattgcaattgcttccctgtatctttttaattttttcacccccttgttcgcatctgaaacagaaaatgtctgttcaaccccttgatcccagcaattagctaagtggtaggcagctggttatctgggggctggctcaaacactgaatcatctctgttcaggtctgaatgggaagcttctcgagcagcaacacctataattagtgtgtagttgcaagaaaggttttttgggagtggcaggtctcaaagcggtgttcccagatgagcagcatccccattatctgggaaactgtaagaaatgcaaaatctagggcccccaccccaaacctactaaatcagaaactggggatggagcccagcaagattttaacaagccctccaactgcatgccaaagtttgagaaccactaccctggagaagtagcttcacagggttcggcagccagactcagggaggtgggaaaacagactgcaggaaacccagggaagtttagaggctgtgaggagggggtgatccttccctcttggagatgaggaagatgcccagaggaacaactgctagcagtgagattttgtgctgagagctcctgccctctgaaaaaaaacctgggtagccctcacttgccttgtgctctgaaaagataagttcttaagtcagtctttgggaaggtctgttggatcatcctgctcaagagtctttttgaaaattctatgactaagtagatgaggaaagagaaacatttcccactttgggtgagtctcattttcctctgtagaggcatctaaatgctgaggatgtacttacttgatggccaagaggaaataggagtttgtatttcaacctctaccctacaactgaacatttactccataagaatcaactctttactgaggctcttttgaaggtgctcagtcatggagtcctggtcaacatgctaaatttgcctgtggttttagtatcacacttgtttcatggattatgggagcctagaaatgaatagtctgccacttaccaagtatcttatattctctaattattaagaggatataagttaagttagttaacccgtagcaatttagggtaagtcagttttctactaccagaggcagaactagtgttatttcagttcataaaactccacttttttttttttcctgttggcaacatatgcccatgtaaatccttctgaggtggatatgcctcatcagactggaaatctaagtctgtgtgtgatccagagtcactttcctttgtagtttttttttctttaaagcacaatttctttgctagcttttgaagtttctgtgtatctagacaaggaaactcctcctactttacacaagaagggagaggtgtttgtatttcattctccatcctataatgtgcattaatcattaagatgaagtctctttgggaggaaaataaatcctggttgatatggccaactcttttgttgttgaaatatgtattctttttttaaaggatcattgaacttctccatgggttgtttccatttggggaatgaaataatggggatttggaagctccactctgtggtctctgattgtgcgagtccgtaaactacaggcactcagaggacttatctcagaggggatctgataaacagttctgttgccacttgaaaaaaatcaggcaggacatttctcctggggctgtagtggcaagcaggaaatagctaaaagggatagaaagtacattgcccgatcactcatcctatatgggtcttttgtcccagagtttcctgcttctctgcctgccccctgccccctcatattattgaggtatgctcatattacctgccagctccagccagaggaaaagccacccgcgccagcggcatcatttacttcctttagtatttcagctccaagtctagtacgcaaggaatgataatgaaacatgatgaaatcggttctaaattttttgaaaggattagagaaaaggaaaaggtcttgtatggcttcaacatggtttcctgtaaaccaggggtgttgttaaggtgcgtttttcaacacccatgtcctctagcttcaagccctctcactgtggccattgaacataagcattatgaggagggatgacagaaaggaccaggaaggtaagaaacagtggagaagtcactgcagccaattccttatgctcttctcaatacctgtttccatttatgttgaatccaagtatcctctgtggcattcagctcacatctctcccccaactattccattttctaccacagcctagcaaatacttttccaattagctgtatttctaggttaccaccaaattaaccacagaggccacgggattaataggagctagggaactcatgatggccccaaatatgccaccagtaactccaccaataacgactgtgagggcaactgtaaggttttggccttggtgaaacaatagtcagttttccatgatagtcttggaaaccaagccctttttttctctccccttgactgcgtatacatcaatcttgatgactgtgagtttataatgcacagctatgtgagtccccgctggcacaagtgagcacctgagtacagtagttacctacagatctccccatccttgcttgcttattctctgacacacacacacacacacacacacacacacacacacatttactctttagtaacgtatcctgcagagatgcattgtctcttcaaccctggagtctataggatttctggtcaacctagttcctgtacatttttcactgcaactagagtggctgggaactctgacacccatggacctttgggtcttgtttttgaaacaaaaacaagcacccccatggcctgagaattgcagaagtatcaccgattcactgtagcctggattttccttttttcatcgaaattagtacctgtgtaggagagcaggcctagagccatggcaggctgtgatatttggcttccttgcttgtgtctcctttcagcattggactaaccaaattccatgctgtctttctacccaattccctaccttagtgaaaacctggcaattgtcgtttttttttgttttttgtttttttttgaactgtttttcagtgttgttttttgttcagtccacctagtttgtgaatgcaaataaaggttactcttaatgcttgtctggagatttttccacgtgatttgggagatgatatagggcatgtttgacttgtagcagagatgaagaatggataaatccagtgcatggaacatgatcggagattcccacagactaacttaccctgcctctaagtgggccccgagttcctctactgcacagattcctgcctgttgaacagccaagcgttgtccttacagaagtgcaactatactaactggtattgcacacagtgatttccaaagtggcactactaggaaatccttcatcttccatttctcaagctggccctctcctggagggaggaggtctgtcgcttccctttagctaaagtgttttgcttctcttggtattctgtctcctttccctcacctcacttcaccttcacgttcctggcctgggtgttactatttacctactgatcacagaatactatgtgaatttccattcacagctttgagtgtttatgaggctttcctacttcccacccagcccaaaccttgggactttccacacactgatcctctgatcagtttgacacaggaaagcacacagaagtcttgtaccagtttgtatagtagtacccttttgaactggcgactcttgaagtagagtgtgctaggggtttgcattggctgctcgacacacacaccaagtcaattagcatgcatgccaaaaaaaaaaaaaattaacccttagagtactgcttcaaccttttggtttaatggtctgaatttgactggtcggacaatgcttctttccccagatccgagtcctgcacagaaagtctgtgcttaatctagccagaacctcacccaggatcctctcctctctagctttcttgagatgctcctgggtcctgaatttattaatcaactaatggtttttaaaaggtccaaaacacaaccactgtgtttaattgaaaacaggccccactgccaatgcgttggagggcatgaggaactgtgttttagctttagtatgtgtcctctcaaagaaagaaagaagttctttaagggttaatatgaaattaaggaatttggaggcctctcctgcttgtccttcctccagggtatctgcatgatcctctttagattcttagttcaactgctgaatgatgataaaaaatgatagtatataataatttcgaaaacaataaataaaagaacagtagttcctgaatggttgaatggaaagaccccttggcaatgcttgcttgatgatcccaggaggcagaaagaccaaatgttttcttttatgaatattcatttcatcgtctaccctaagcactaccacttctcagcatcgtgggagacaggatgatactacctgtcatttacctcttgctttttcttcttcctgtctaatagcccaatagaatcctgccagaatttctacaaagatttcacattacagatcgacatggctttcaacgtgttcttccttctctacttcggcttgcgggtaagtttgtgcaacattgttcagtatcacaatggggtgtttcagtctgggacccagggatcatccccctcagcctctgctctcgcagtcaagatatttccaggagaaacagcgcacccgcattctgattttcagtctgagagagagccctctccttagctaagcattttctggaattcacatcagttttgtttcaagggggagaaatagggattgaagaaaaatgatgatgtatccaccggtggattgtttctcatctctctattcacataatgccctgttcccttaaaaattaaatagaaataggctgagtgtggtggctcacgcctgtaatcccagctttgggaggctgaggcgggtgaatcacctgaggtcaggagttcgagaccagcctgaccaacctggtgaaatcccatctctactaaaaatacaaaagttagccaggcgtggcggcgggcatctgtaatcccagctactcaggaggctgagacaggagaattgcttgaacctgggaggcagaggttgcagtgagctgaaatcacgccactgcactccagcctgggcaacagagtaagactccatctcaaaaaaataaaacaaaacaaaagtaaatagaaataaacctcttcagctcttaaaattacgtttagcagtgttcacttagctgagccctgagagagcagttgtgagtatgaatgaaaggaaggtgaggagagtagatggatggaattttgtgtgtgtgtgtgtgtgtgtgtgtgtgaatgcgtacatatgtgctttatttatagttatatttacatgaatgagtctaatacaagtaaaatcacccaatcttccctatgaagctgttgggaaccacagaaaaatacactgcctgatctttctcttaagactagcatagcatatagttagtctatatagggctctctatggggcactagaaaacgtgtgtgtccaatcataaaagcatgtgctttgtgtagatatgagaaggacataatgtctccctccagaccttaaaaattaaatagaaataggccgagtgcagtgactcatgcctgtaatcccagcactttgggaggctgaggcgagtggatcacctgatgtcaggagctcgagaccagcctggccaacatggtgaaatcccatctttactaaaaatacaaaaattagccgggcgtggtggccctatgaaaactcaaaacttaccctttgacaaaagagtgtacattggatgccagcaccatgcttctcatgttttttctctttcttatttcttctttcccccagtttattgcagccaacgataaattgtggttctggctggaagtgaactctgtagtggatttcttcacggtgccccccgtgtttgtgtctgtgtacttaaacagaagttggcttggtaagtcagcctctctttccttctccttcctggttcctgagtcatggctgaaggacagaatttgcagtggatgagggggctgtctccctacaaacaatgttgtatgtattaatgtgaacaacgggctcttggagttttagaagttgatggtggcagctctctttggagcactagccccaaagggtttgcacagtttgcgcttcaggcagtgcagttttatcattgtcaaagcctagtggtcatcactgtcacagccagggcctttatgttcatggttctgtcacttttcattcaggaacttagagtcaggactggattaagaagcccatgggggtaaggccaactttccgagtggctggctcaggtaccccagaggcctgcctgccaaagttagctttggtctgcttccaaaaagtgggttctgcatggtctatttataggtacaaggttctttgtagggcagggagagatgaagcttcttgagtcatctctcaccttacaggagactgaggtccctttctgtgttaaggggagagtgctgctgggctgtactgtacagggcacctcctggaccaggactagaacactttagtggagaaagtaacttgaccagaggatagtcatggaagcccagggcttagagagacagcttcaagtttctcattgctgcgttgatttcattttttccctgaattcagagtattcctgctgtcatggggtctactagggaagaaggcaggccgaaacagaacctggaggactatttgtgggttccttctgtccttatttttaggatttttggcttaattatttaaaaagtaatatgcatgcattgtaatcaatgaaaacaaagatgtgtgaagagagcattcatcatcttttccccttgcctccatcactgcctcctcctttagacacccacggttcccaggccttcacatgtgcacacatgatagtgttttagagatggtggtgtttgtataagaaattgtttcaaataattacattgcaccacaatttggcttcctaactaatcatgatggacattccgtcagctctgtgataactcattttgtaagagttgcataaaattccataatttgtttgtatcgcagtatattcagccataaccctaatgatagaccacctgaatgttttccttttccttttattgctgctagaaacaatggtttaataaacactgttattcatatatttgtataattctaattctatcaatagttccaggttcctggaagaggaactgctggttcaaagaatatgtgtattttcttttgtgcagacattgatggataacttaaaaaatgttgtgtcaagataggcttccgctagcaatccattttgatgccattgctagcactgggaatttattatatacctagtgtcaagtatttttttaaaaaataagcatcttcttaatatagtatgtgtggtaatctctatattatatgcacatacacgtgtgcatgcatatatatatatatgtatgtgtccatatcctaaaaagatttcttttgctacagttttctcattagaattatattctcttgctctaaggaaaagtttttgttttggacctgagatatgcttggttagactggattttttgcttatcgtatcctgattcctccttattttctccgtatcgtatcctgattcctccttattttctccttatcctgatgaggctagtagagtcacacacaaatctgagaagtgtcctcagtgtaacttacgtggccctgggtgccagcagtcccagctgctgtagcttcactgctaactggctttgtgacctgggagctcaattttctttacctagcctgttgtttttcatctgtaagataaagatttggctagatgacttcgaagaatcttttagctcagaaagtctttaaggttcttgggtcattaatgggaaatttgggatctaggtcattggggtggacagggaagctagtagaattctatcagcagcacccctgagtcaaaattatggatgagttgttaacagggactccttttaaaacatcttgttgctaagagttcaaacacatacccatgcacacacagggaaatcgatggggaaggggagaggtgggatctgccttcttcactgagctgtgcttaattaccctgtgcactcgaacaaccactttgcttttctggatcctcagttttctcatctgaagaatgggggtttaaatgaaattaccttctagtcctcacacttcatgaatctgcactttctgccagtgtccattgtctcttggtcccctgtgggcctgggtgatggaagggctccctggtgactgtggtggagacatcctcctctgcagtgagcagaacatgcccccggtaaaagtgtggagcccagcttccttgtggtgagtgacacgttccctgaagcattttagggccaggagttctggtatgctttgaaatccatagccttcctgtggatgatttaattctgatttttggagatatgttgtgatctcataaaaaatctattggcacaaacacagaatgggggtgaaaaaaattgaataggaaataaaagaggtggaaatgaatttctaatgagatacatctttgtatcaactgtggtcgctttccaaaagaaatgtgctctaaatgtgcttccatttgtatattaatatttattgagcatctactatatgtcaggtaccattccagatgattgggaaacaacagtgaagaaatagagtcctatccccctaccctcctatactgcagtgttgggaaagcaggaaacactgaacctaataaggaagtaaatgatacggtatggttaggaagcataagtactattgaaattgaacacatagaacaataaccttttgggatatgaaataataataacaaaaataaaaaaacctctttcctcttgtaggagaaagcacctttaatgaaatgctttaggttctttggtagcgaaatctccttgggtgaaatctaaaactgatctccctgttatggaagagaattcagtacaataatatttcaaggaggttctcatctgacttaatacatgggttattacattgtgaaacaaccattgtaccaatgagcttccagagagaaaatgaacattcccatgagatatgacttataaaggagaagaaataatcccattaaataggggcatttcaggcatggctgcccttctcctggaaagtggaagggtgctgccttttctggctgaggtttgggataagatgcaggaaaccgaagtctatccccattctcctgcacaaactttcctggccctgctgagggtacaggactgtgcggtagctggctctgtgggagataaaaaccagagtgaatgcagggtccctgcccttacctgtcccagaacgctccccacaccgtgtttagttttcaattgtcggcatatgattgcgtgttgtatagtacagaatatattcattgtgcagatcatcctagtgcatgtaacggtgtactcatagagacactactatgtagtcagctcctactgtgtgatgggcactctggaaagcccctcacagacacggactcacttaatcctcagagcaaacctatgaggcaggacttgtcatttccccatttacagatgaagaaactgaggctaagagagattatcttgtccaaggtcacatctcctgggagtggtgggaggggtgcattccccagtatgtggtctgactttatgtccacactcttcctctgctcttctttctgtgtccttaccccttgaatgatttggagttgtgaggcctgggttgggaatgacagggctagttttgctgtgttgtgttggcatccctccatcggtgcttactcataaagggcttcactccaggcaggaagagagggaagagatcttatttaagactccgtgttctcctggctcctctttccccctcctccttgcccacctccagtttctagaaatgccaggaggaccagaagaatgcagagctagcctggtgtctcccgagtcctagtgcccctcagcagcttggagatccgacctgctccatctgggacagagagactggggcttaagaacaccccggatattggcgcagagtagattaaagctcagctctgagctccaccaactcagtccacatcttggctaaactgtttgctgatgggtcgctcagcatgagcattttatctgcctcaggctcagttatctcacctgtacaatgggctaattacagcacccacctcatagggattcaccgaggtaatgtgagtagcacagcacgtacttcatacgagcttaatgaacagaagccaggattacctcggtctctctttctaacctacccatcatattttaaagcaccgcaggagaaaacaaaccagaacagaataaaaaataaggcagcggatgtgaggacagtcatgtcggcaagcagcaagacgctgcttattttaattcctgtccccacccaccaacttattcattttgtttcccttacaaatccaaacctcactaaaataaatgcaccttgaaatgagagctttatcttattttgagatttgaataacatgctccaaggagaactcatatgtccgtctgtctcattctcttttgggaatgtatccccaaggtaggtcaatgggctgtgctgcctctgtttgtgtgtatgtttttttgtttttgtttttgtgttttggagtttcgcccttgttgcccaggctggagtgcagtggtgcgatattggctcgctgcaacctctgcctcctgggttcaagcgattctcctgcctcagcctccccgatagctcagattacaggcacttgccaccacacccagctaatgtttgtatttttagtagagacgggatcgccatgttggccaggctggtctcaaactcctgacctcaggtgatctacccgcctcagcctcccaaagtgctgggattacaagtgtgagccactgcaccttgcctgtgtgtatgtttttgttgagggtgatcttgtaggatttaaagaagggagtaggaggaaagtaatgatgcactcaccagccagttttctagcccatttttattacctactgtgtgctcagcactgggatgagaggaacacatgccgggccaccctgtatcctactggtactgtgatttccaacaccatcccctgttctttgactgatgaaatcggcatatgataagggaccatggtcattggaaccatgattggaaaactataaacttgattctattgtctgtatcagaactggccttagaccttaaaccttaaaaccttcagtaaactctgctagaaaatagaaaaatgagttaatgcccaatcacagggcagttgcaatgatgtagggtatctgcttataaatatatgcccaaaatagtcctttttttgtgtcagaaggcaataaaaacaggattatataaaaaaagcacaggtgcttaaaaacaacaacaacaaaaggacaaaacattgttcctgtttgagactaaagtttcaatctcattttggaaccaaaataaacacacatgcagtgacagcaggtaacactacccactatataattaagcccgtaattgcaaggtacaggctgtaaaggccatgggagttcagaggagtgagagctcatgtgggtgggagaatgaggataggcttctgtgagaggctggggctcagtggaggctgcaatgatgggctaagacagggagaatgaagcctagtatgtgtggagcatggtgtgtacccacagaagctaataacagcctagagaagaaagtggccttgctactggggaggatgaggcaggaggacccctgagctcaggtgtttgagaccaacctgggcaacatagtaagaccctgctaaagaaaagaaaaaagaaaagaaaagaaaagaaagaaagtcagaaagagagaaagagaaacagagaaagaggaaggaaaagaaaaggaaagaaggaaggaaggaaagaggaaagaaggaaggaaggaaagaaggaagaaagtgaaggaaggaagaaaggaagcaaggaaggaaaggaaggaagaaaggaaggaaggaaaataaaaggaaggaaagaaaagaaagaaggaaggaaagaaggaaggaagaaaggaaagaaggaaggaagaaaggaaggaaggaagaaagagagaggccttgctgagtgccaagcatcagcctcacaaccttgcaaaatggtgtagaagttttctatttccaagcagttctgtgggtgagaagtccaacatgggtctctccagaggctctagggaagattccatgtccttgccttttccagcttctagaggccacctacaccccttggctcatggcccctttctccaccttcacagccagcaactaagggtgcatccccaccttgcatcactctgatcttgcttcctgccatctcttctttgcctccttcttctacttttaaggactcttgtgattacattgggcccacctggatactccaggatactcttcccatctccaggtcagcctatcagcaaccttaatttgcctgctgcgttcatttccttctggcatgtagatgaccatattcacaggtcccaagattaacacagacatctttgagggtcatcgttctgcctaccaaaaggggcatattattattcccattattatttccaaagaggaatctgaggctctgaggggttgagtaacttgccaaagtcagagcccagaagagggtgcgctgggatccgggcccctgttcagatgtgccaaaagctctgcagagccttttggagtcctttgctccaggggtcattcacggccctttggggccatgcttcatgttattttacagcctgttagggaggagaccgttggggagagccttattgaagctcaacaccctcccacacccctcatttgcatggagtgacatttttttttcttttcatgggaacaggtgagttactagacagacttgcctgttgtctgttgttcttacgcaacttactctgaggtttgggtgccccttcctgtgcagctgcagtgactgaggggaacatattaggtctgcataacctccacctagtagccctcttttttaggaatcatgctttattgctttctggagtttacagagaaacccaaatgagaccaaagagttgtggtggtaggccaccattttcctaagggaagcggtggatggggtcagcacaccactcttccttttaatggttaccccacccagggctcagctgaagtctcaagcatctctctgttcctctgcttcaatggagcatctgggcccaaggccacctgcttggctgaagagccccgccccaccttcaggcagggtcaggatgattctgtgaatctctggaccttctgttgactggcctctgcatttggtaagaataatcaagaatgaaagctgtggcctggtttcagtttcctgacatcagtaattttcagtgtttgggatttaaacaaacacaaatagtatggtttggccagagagtggaggcagaccctggttggcatccccatatgcacagccctgcctcctgcctcccctttccctgtacttcctgccccagctccactaggctgctagctgcatcttcttgctgtctctgccctgtgcctggtcatgagtaagttcctgccctgactctgcaggttgtaatccttctccccattaaggcacagctctgactccagctcctgtgtgcagctttcccattctcatccattggaatgaattcctctctgacctttgtattgtgctgttaggattcgtgctataggagcaccatacgcagcctgctttgtactgacaggtaggactgcagcttccatgatagcaatgtggcagggactgtggcccccttgtttttcgctatgtccctagtacctggaacagtgcctgacacatagttcatacttgttgaatgaatgaatgagtgagtcttcttaggatcatgatagtaatgaacagttattgattgcttattaaaagtaggcactatgcccagcatctcacagtcattctctgagttaatattcacaataactcgatgagtaaatattcatagcccaagtttacagtttgggaaactgaggttcagggtctaagtaagtggcaggtccaagactcaggttagtccaattctggagcccatcttttaaaatgattagaccagtggttctcaaagtgtggttcctggatcagcagcatcagcgttactggggacttgttacacatgagggttcttagagctcaaccgagacccagggatcagaaaccgcgagttggagccagcagtctgtgttttaacaagcactcctggtgatctccagttttggagccaccgtactgacttatgctgggatggttctcgaatttttattagaatcccccagagtgcttttaaaactcttcatgttcaggccaagcctttaaaccattaacctaagaatctctgggtggagggtgtgacctaggctcagcttcttttaatgtttctcagttgtgtctgaagtgcagtcaggatgagaaccacttgtatgcatctcctaactttctaaactttactgtgcatgagaagcaccaggagatcttgttagaatgcagtttctgatttaggaagcctatgctaacgtcagagatctacatttccaccagctctcaggtgtagtgattctcctgctctgtggaccacactttaaatagccaggcttaccaatccacttaaaaatggccaaaaccacaattacttttgcaccaaactaatacactgtgctgtccagtatggtagctcctagccacatttgcctatttaaaagctcagttcctccatcctaccagctgtttttcaggtactcaagagccccatgtggctcattggctgcggagctggacagcacagatgtggaacattccatcatcatagacagttctgtgggaccacgctgctctagaatgagtctgtgacagcacacaccatggctttttactttttgtatgcccaggacactcttgcacatagtggaagcttagcaaatgttttttgaagtgattttgagtgaatggaccaatggtaaaaattctatatctaaaagaaataaataactttcctgaagaaatgctagagaaatcatgaatacactgttaaaaggaaccctctaccaccctacccaaattaaattaaatatacttaaggactcagtaggccaaaaagcacaagagacactggaccatgctccagctccaggacacactactctgctgctactgaaatggcattttgggctctgaaaggaaaggtctctggtgccccctagaggctggtcctgcaatttgctggatttgtgagcaattaagtagcaaggggagaggggaagggggccaatttcatcatgctcagatgggcagttcgtggttagcagtggtggagataggctcactttgaactcctataagctatttgacatctgataacttgactcaaccgctatgaccaaaagcacccctcccccaagggagttgcttctcagtgacagtgcccgaagcctggaaggaagggcccctgagtgcccccagaggtcacccactccatgttccaggcagctgactttcaacttggacatctagattccctgaagcccagagccttctaagtaaactgctgtctgtagtctgtgggtttctttagaataagaatagtgaaataaagaaaagaaaaagtatgatttccctttttgggccaggtgtccttaggagagtgggggttggggggtttgagagaaagagaaatccaaaagaaaagtgcttccataactagaataaagttagatgtgttcatattacacatattacatatatgtgtatatatatgtatgtatgtgtatgtacatacagtatataattgtctcaagtgctcttccaaacagtactatgaaataggtgtcatttgggggcccatattacagatggggaaactgaggcttcagaaggttaaataaattgctgagagtcacctagtgagtaaatggtagagctcagctttgatctcaggcaatctacctccaaagtccatgttacttgatatgatactatgctgtctctcaagctacaagttaacacatttttaataacttaccagcctccaaactacttttttcccccaggttcaccagtcccctcttctgagcttcttgacccattctatacaagtagccaaataaataaaaacaatccatgtttttaccattagtccatgttgaaatagtatcatgctagatgttatgggctgctatggtctgaatgtttgtatctgccccaaatgtatgtgttgaaatgaaatcccaatgccgtcgtgttggagatggggcctctgggagatgattagatcatgagggtggagccctcaggaatggtattggtgcccttatgaaagaagcccttgggaggctgtttgtccctcccaccatgcagggaaacaagaaagtgccatctatggagcagagaaaaaaccctccccagatgctgaatctgttgtcgccttgatctgggacattccggcctttagaactgtgagcaatcaattgctgttgtttataaattacccagtctaaggtattttgttagcgcatatagactgacatggggctctactcttggcttgagctttttttttttgtttttttttgagaaagaattcaatggcaacatacaccttatgaatagcattgcaactgaattgctctagtgtgacaagaaaaatgaactcattattaagttctgtccctatgattgggctctgaagaaggcagcccagccaagtggaatactaaaaatttggatgtatttcagggagctcattgctgttccggtcgctgctatagctaaaactgcttctagagaaattactcctctccaagagatttccaattgtgttcccttgatattgctttgtcagggacacgctttaaataagatgccctccgtaagtagagattctaaatcctcattgatttgcatggctctgttatatgccaaattggaaataccatcctaaaatgaatgtcttcaaggaacgaattcagcagtaggtttgcatggatgccaaaacctctccagatggctgtacttcatctggggtattattggaacagcctcctcagcaacctaaatctctaggactggacgtatatttaccttcacatcatcttcaaaaaatagatgccttgattcttttccatgagaccagggccataatggattgacctggctagcagatcagatagggagaaaatgaacacctgaaaccagctcagggattcgactgcattattcagctgaacacctactgtgtgcaaatccctaggtgctaggagtgacccaaagatggggaaaacatagatcttgcctctataagatgttaataacttaattggagtgtcctctagaaagaacagtaagtttataggaatttagaggaggaacagatggaggaaagttggccatcccagcccaaagtagatttcaggtatctaaaatataaacatgtttctcctagagcaggactactcgaggtgcggtctgcaagccagcacatggcctgggagcttaatagaaataaaaatgttggagttcaaccctaaacctggagaatctctgaaaggtggggctgaggaatctgttttaacaaattctcctggtgattcttctatgggctaaatgatcttggcagtatgttagaatcacccaggaactctgacacgtcctcctggccagactgtatttctaaccaagcatatgagaattggggatgaactcagtcaccagaatgttttcaagttctctgaataatttcacttgtgcagccactgttgagaggcctggcacagtggtggttcttaaaccagaggaacatacctgaatacctgagaaacttcaacacacacacacacacacacacacacacacacacacacgcacacacacacacgcacacgtactttccgaaatctattctgtgaggctctttgggtcgtggtaaggacaattgctttggaacaagcacactatgtattctagatagaccagtggttctcaaactttgagtgcaccagagtcacctagaggtctggttaaattacagatttggggtgttccatccccagagtttcagattcagtacacctgggatggggcctgaggatctgcatggctaacacattcccaagtgatgctgctgctgctgatctgggggccacactttgagatctgctggtccagcccacggtgaggctgaacttgaattctagttgtagctgctatgcaagtttccaggattctggtattagagtaaaccttgctattttgtgctcctaaatatcagtattcttattaatgtaatcctttatttcatatgtttttgagattaaaatctgagtcatttacatcttgagatatactcatcctatgatattccatattacaatttcaacttgaacagcagaacccttttcccatagctcttggatcttccacttgtaatccccttctaaggtattccaagtccttggttactagtaagaatgagcacctttgcttgactttattagtcactagtattttgtctagagccaatttggttgatatcgcttcctaaactctctgaaattaggatagggtcaactcattcaggaaaatagatacagggtgtgttggagattagggaaggagaggggcggagggaggtcccaggccaaatttctaactcatccctagagtctcacctccgacgttctcccagggatggagcctcacctctgaccttctcccagggatggagcctcacctctgaccttctcccagggatggagcctcacctccgaccttctcccagggatggagcctcacctccaaccttctcccagggatacagtatctcagcccgctcctcgagggaagggctctcttagggtccagcctctctccaatagcagggtgacttatttgaacaaatcttctttcccagtcatctcacttgcagacactgagatgcccaggcctgggcccaagcctgctcatgagagtaagaacagatgataggtggtgagcagagctccatttttcttttttttaaatttatttttattattattttttagattgggtcttgcattgttgcccaggctggagtgcagtggcacaatcttggcttactgcaacctccgcctcctgggttcaagtgattctcctgcctcagcctcccaagtagctgggattacaggtgcccaccaccacgcccagctaatttttgtatttttagtagagatggggtttcaccatgttggacaggctggtcttgaacacctgacctcaagtgatctgcccacttcggtctcccaaagtactgggatacaggtgtgagccactgtgcctggcccatttttcataagacacactatatcactcgaaataaatgccaaacactagtgtggtgacactttgctcccatatcacaatcactaaattcgacttacccctttaaggccaggtaggaatttagcaacccagctcataaagggtaaaattagcttattatttcctgagtggattgcaaacctcactggccagattgggagcacagcagatacttcctttttgtaaaaacttggctgagtgtggtggctcactcctgtaatcccagcattttgagagcccaaggcaagaggatcgtttgaggccagcctaggcaacacagtgagaccctgtctctacaaaaatttttttaaaaaattagcccggcatggtggcacatacctgtggtcccagctactcaggaggctgaggtgggaggattgcttgagccttggaggttgaagctacagtgagctgtggttgtgctactgtactccagcctgggcaatacagtgaaatcccatcttaaaaaaaaaataaaaataaaaaattaaattaaattaaacaaacaaaaaactcagtctcatggtcttccttctttatattctcacctagccttcttctccagccctgtttgcatttttgtgaatttctcccattttcactctagccagcctacttaccaaccactcctacccaatctcagatatgttccatctccatggttttggtagtttcttgtctagcagctgctttcttgtcttctctgcttacctgcactcaaccagttattatcctgttacttgcctcttccaaaaccactatagtctgagccactcttttgatcatgggtgatcttctgatgtggttgtgtttttataagtaacatgtacctgtcctgactcatcaactagatcaggagttagccactctggcctactgcctgtttttgtaaataaagttttcttggaacatagccatgttcattcgttcacatattgtttatggcaatgacatgaagaagataggacccaaaaaagccttaaaaaattattatctttctttttagagaaagtttgctgatccctggtctagatttgcagctatgttatatattcttttatattcctctaaatgtctggcactatgttttgcatacaatagctactaatcaattttgatgacctgaacatgaatttttctctgaaatccttataaatgtaataggaataaaataagttatttttgctcttgttattgttattattattatagctgctatgtacagtcctgctacataatgtttctgtcagcaacaattcccatatgcaatggtggtcccataagcttataatatgtatttttactgtatcttttatatgtttagatgcacaaaacttaccattgtgttacagttgcttgcagtattcagtacagtaatgctgtacaaatttgtagcttaggagcaataggctataccatatagcctaggtgtgtaggaggctatacaatctaggtttgtctaagtgtactttatgatgtttgctcaatgacaaaattgcctaatgacacatccctgtcattaagcaatgcatgactatattttgtggcaggtattggacaaagctctttaccggcctatctcatttaatcctaacacacaggtagaggaacttggaacttggagaggtgacctgtgtgacctgtcttacttgctgtatgacttcagcaagtgatacagcaagaattcgaactcacatctttgtgatctcagcgcctgagcttttaattactactatatacccacggtttagtagtaactcatacatgtgatgagagacagaaatgtttaaaagccctaccaatgagataaatcatgtaaagaaaactggcctatgttataaataggctaggagcaagatgaagcaagtgaccctgaaagcgagggcctcagctgggtgcagcagctcatgcctgtaatcccagcaatttgggaagctgaggtgggaggatcgcttgagtcctggagtttgagaccagcctgggcaacatggtgagaccccatctctacaaaaaatacaaaaattagccagacatgatgctgcatgtttgaagttcctgctatttgggggctgaggtggaaggattgctcgaggaagtcgaggctgcagtgagacaagatcatgccattgcactccagcctggggacagagtcagcccctgtctcaaaattaaaaaaaaaaaagaaagaaagaaaaagaaaatgagcatgcctttcaattttgttccctggatgcatcactgtcttaccctagtctctgccctggttaagaaacttcataaatattgccggtttcattattatcatcatctttattattatcatcattcactcaacaaaccttaaaacaagtgtaatgtgccagctgttgtcctaggcttggagtttaaactaagatattttagccctactataggaaagatgaatctataaaccccagattgcaaacacaaatgcttacagggacaagaagataacaaatgggtgaagcaggccaggtggaggctgtctctagcaggagagtgaatgtctctcttcaaaggaaggctgttccatgaaaaagaatgaaaccctgtcatttgtggcaccgtggatggaactggaggtcgttgtgttaagtgaaataatccaagcacagaaagacaaatattgcgtgttctcattcacatgtgggagctaaaaaaaaggggatctcatgaagatagagagtagattggtagttatctgaggcagggaagggtaggaaggaggggaggatgaagagaggttgattaatgggaataaatatacacttagatagaagaaataagacttggtgtttgatagatcagtagggtgaccagttaacattagggtgacaagttaacatgaatcaattgtacatttcaaaatagctacaaaagaataatttcaatgttcctagcatgtagaaaagataaatattttaaggtgatggatgtcccagttaccctagtttgacaatatggatgtatcaaattatcacatagacactgaaaatacatccatctactatgtattaattttaaaaagaggctattgatcaacctttggcaaggtcttgctgtattgacagcttctcaatgtccactagcagttacctccttctccccttcatctttcctacattaaggcaaaaatacagtattcagttaaaactcctcctcccctccttcttttcttcttcctcttcatcctcttcctccttctcctctccctctccctccttctccttttcttttccctcctccatgtccttcccctcctcttcctctctttcttcttccttcccttcctcttcctctgaatcaatcatttttggccatagcgacttgccctttgcaaactagtatgtgttgcagtattatgatttctctgcttgagacaggaacctctggtgttttggaggaaatttcatcttgggctgctccccttcttaccacatctgttgcccagtatccaccacaaagcctgtaacttagcatctgcctataacaccaaacaggttgcatcagataaacaaaaattcttactgtggtaggtgaatattttagcaaacgtaaaatactataactcgaatttacaaactgggtcagaagtgctttctcatgttttggtgtctggagcaacgtgcacatggtcagaggacttcttatttcaattttcttgtttgtttatatttattttatgaaataaatagcctcccttccattagtacaagtacttctggtttgttagagacgaagggccccagctccactgggaacaaaggggacctataggaaacacaagtgtcgccagcttttccatgcactgacctgccctaatgtgtatcctcctcccatagcccgcagagactccccaacctcactttagctcaactgcattttccccagactgttctgaaaaatgtgttgtgacgtgctgccacctagtgaaggaaagtaggaatggacattatagtggctgtcgccctcagaatcctctttgaagcctggtttagttaacctctgccgaaataaggtcctacgtttttaactttcagaaaataactcttataagactcccaaagggtccaaagactatttagtgaagactgaagaagacaaatgtcaagtgaatagctaagagtttgaaaagtaggtatacgtgttcgggctaagtataaatggaaaacaactccccgcagaaaaccattctaattggacttgcagggcaggttaagaggaggaagtcagcccgactccagagtacagacattacctgttttcactaaaataaaggactgtcttcaattgtttgcattatcattttatctccgtagaatattttccttcggtcttttgactgaattggttttgaatttaaaagaaatattgaaatgatctgtcactttactttttgcctatcaagctgtcagcttcaaaaaatgaacaaatgtatggattctgaatagatatgtttctcagacctaaaaagaaagaaaatgtgttaataaacttgcgtctagtcatcatatgtgtacttcaatgtgtcagaactgatttatgaaccagaagtactgtgtttaagtgaggacttctctgcattcatattttaagtattattatttcattctttcctcttggggggcaagttagtataatattaccattgactaccgttgggtgggtcccaaaggtcatttctgtggaggataatagagcttttcatatgagacactttcagctgcctagcagaggcagcacactatgacaagtggccaaaaaaaagtagtgaatatttttatcgtgagttttcatggcatgaatcaactcattcttcagaagtctgtatttttttctttctattatggcatgtctgtcatttcctttgactctctggctggtcttcatctcagcaaagtggaaaaaacatattttagatgggaaaaaatgggaagaaactgaaagagggaaaatatccctaatacaaggagaaacacaactctagattccctattgccatatggaacatttaggatttcccaggaggaaacacgttcaaccagttgcttctgttacctccggactaagagggatcctgatagtagctgtggctggtgaaggaacacctctattatctggctctgggtgctgcagaaccaggcagttaacaggacaagaaaaccaaatgatccatgggtgcaaatgtgcttttgccaaagccacttccctggggtctagatagcgaagagaaatggtggcttctagaggaggaagagctaggaagtaatcctggagtccagttgtcttttcttaaagatcatgtttcaggattccaaaaaaaaaaaagaaagatcaatggcatgtaggagggtgggggacaaagagggtgaattatgagtttgtgtctgtgttttaaaatagccacctgccttgaaactgccatttagaaatgtgcatggaaggagaatcttcctgattcttagctctaatttatggccaatttatgaagtcaaggtcatctctcttcctgctggtgtgtgttcaacctggcctccctttatgccaaagaccttgagcagaccttggctaaaacccccaggtatactcccattcactgtcagcagtgatccgtggaatggattggggctggccgccttgccttgggcagagttcatgtgtcactcaggaagatgcatcaggctgctgagtcagagggagtctgccttatgtccacagagaggagtgaatcagaaagccagatgagtccagctctcaggacatgacaaattgcagaatgccgagctgggaggcttgagtacatcatatccttcttattctactgatgagaaaactggggcctggggatgcccaggaatttgcttacatttcttctcctaatgaattaattctttcatttgttcaacagtgatgccctgagtgtctcccgtgtgtcaggctttgttctaggtgctggggttagaaagaggaagagtgtcacatgaggagaagacacatgtcacaggtcattctaaaagggaaacccaactgagaatgaagagtgtctcagggcagaaaaaggaaggagcaaagacatccaccttggcactagacaatttgggtcctgatttgacagtctttagtaattagcataaccatcagtacatcatggaagcttaccccatgtaccatttcttagctctcctcactgttgtgattgcaaaggtgcttggaaggttacttgatgagcctctttctgctgctccagacccagactgtgagttccatcaaggcagggatctttctcagctctctgttttatccccagaatgggacagagcactgcacgcatgggagatactcagtaaatagccactgagtgaacaatggaatgaatgacaaatgataagggttcccaagttccattctatagaataagggtcagcaaaattcttccataaagggcctgatagtcaatgtttttggcttcaggggctgtatgatctccaccaccaccattcaactctgcctctgtggcatgaaagcagccataggcaataggtaaaagagtggacatagctgtgtcccaataaaattgtattcgggacactgaaatttgaatttcatacaattttcatattccataaaatattctaatttttttagctgttttaaaatgtagggggaaaacatttttagctggtgtcctgtgcaagaactggtggtggccagatttgtctcacaggctgtagtttaccaacccctgctataggaggaagattaatagggtaaagattttatgaggtttttaattgattcatttatccatatgtttgagcatttacttactctatgtcaggctctgtagcagacactggacatacaaacagaaatattagtcaccaatatcaagatgaaatcattatccttgatgggtcagatcttccgaggatgagtcacgaccgtgtaggaaatatgaaccccgcagtctgtttaattgatgtatgctatgcactctaaaattaattggagatttctagataaaactttccaaatgtcacaagtatccttccagcatttcatatttacagactggaaaatcaatggagatggaatcattctcccactgtctctaagttaatttgcctgtctaatgctttaacactttctgctagttctgtctcattctttacccattggagagtaccagtgggttttcagataacttccttaaagaccagaaagaaagatttaaaaaaaattccagctccttccttttggctcgggtcttccaggtctttatcttgatgaaaactggaggcaaagatgttatctctggattgtagtcagagaacaacaaaaacccccatcttttctttcccaggaaaatattaatcaaaatagaaataaggtgagattagaaccttagaaggttttgcataatacttttcttgtttgactgtttctggcctgtcttaatccaataatctattaaactctagctagtactttctttcttcatccccagcaaatttgcaatcctccagaatccttttgggaattccaaggcaaacggccttaaacaagaacataattgtctgagagattttgtttgcttatcggaactgtttggtccacagcattatctgcatgggggcataattcccttagctgcagtcagttttacaggtctttgctcataggattacagttcttttacataaaaggatgcttggaatgggggccaccaagagtgccaatatttagtatctttaactgagctcaaagtaataactacttaactagaatcagtgtgcttcttgatatctaggaaaaaaaggcaaaggaaggaaagaacaggatttggggatgtaatttgagattaataaatgattcactcaatagatacatatggatcatagcactctgcttgttgtgcatggtatactgtgaaatgtaagacacaatttcagcctagagtagcttaatctagttatagatatgggaattccaaataccttttctacaacaagagttcaaagtctttcataagtcaatataacaaaagatgaataaatagttaaataatactacagaagagtaaacatgagaagacatgcatttaaatgtatgcagagcacttattgctttggatagaattcacatgttatccatgcgttgactacaagatacatgcacatctctaaacacactcataactgaattcagcttaataggatagtaattgaatgatggaacctagtgtgcctgacttttctcagatgaaatatctggctggtgcaatgcagtaactactattaaaactccatcaggcatggtggctcacacctgtaatctcagcagcttgggaggccagggcaggaagattgcttgagcccaggggttgaagaccagcttgggcaacatagtgagaccccatccctacaaaaaaaaaaagtagttgggcgtggtggcttatgcctgtagtcctaactacttgggaagctgaggcaggaggatcgcttgaggcaaagaggttgaggctgctcagagccataatcatgccgctgtaccccagcctgggtgacaaacacagagaccctgtctcttaaacaaaactcactaggatataccagtgagtccatatgaagaatcctacccatccttctcaccttggcctgaatgaatgagtacaagtgtcagtaaaacagctgttatttatttccttatcccacatctgtccttgaaggctgtcatgtggtcaaggaccatggagccgacagacaatgtttctatcaacaggcagttcaaaccaagcctgtggctgaccatattgagtggatgaaagagccttggagggactgggccttttagaaaaataggctcgtaagtcaagagcatggtgtcagctgtctgtgtgtatttcatggtgagagtgaaagcagatctaaattatgagttgttgagtcacctgcatgaatcaattcaattcttaatttgaaaggaagctcagtgccaagggaacataacatatggaaggagtggcctcaatgactaacaaaaccagggcctattagggttgcctgagtttacttaggtgcatttataagacatgacatttccacagctgttcaactatgtgaaaaccttttgtaagcattactgtatttgataaactctgtgagatggatgttattgttatctctgaattggcagatatgggcaaggatgttccaagaggtctgcagtgtcacacaagtagtaaatagcatagcctgggctagacttagaggtcttttaaccagtcacattccccctcagcagtgagaactatggtctgcccctgctccctcagtgcacgccaattagttaggcctgtattcagatgggatgagttatgttctgattaggaaccacatgtagtatatgctataagttaaaagtaggcagatgtgcctgtagccatagggacttgctgggggagctggacttgagttgagtcttaaaacatggaaaagccttaactaagtggagtggagggccaagagcattccagacaagagaaaaaggtgagcagggggaggaatttgcatccttctttggggagccaggaagtggactggtgtgaatatttcagagtgatcatatagggaggcagctgagggatcctcagtgcgtggttatagtaactggagtggatttactctggggcaggacttactccgttgacacccttggagaagagcaggggaacaggaggagagccttcccagttaccctgttagggaccttctctttgaccgtgtcctgcagatgcacagtagttgggattcatccacctccatccacttatttctttttagctcattttgtttcattcaacagacattcccattaccacattctaggcactgtgtcaagtcttactgaagttactaaaaggaaccctcaatgaatgttttgtgaatttagacatgaatgaatgaacaaaagaaaagggacaagggctggtgagctcattcatgggggagaaggaagtaagtaaagaattccagtgtgttgcattgaatatggcaggagagtgctgggggaacaggcagaaaagagacagcctgacgtgtcccagggaagactttccaaaaggaggtggtgttctggctggttcctggagtctgaagtagaaatttgttagctacaggaggggggaataggcaggtcaaactgagggcaagtgtttgcaaatgaacaaaggcctgaaaattaggggaaaagcaaggatgtaggtgtaacttaagttgaagtggagaagaaggtaaggacagaagaccagggaaaacatttccacctgagactgaacagaaccacctggtccaaggtcacttcgttatgtctttaggcaagccctgggccaaaatggtgtggctctgggaactttgctcactcaaagccctacataagcccatctttcccataagaaggctgagggaacatctatctaagatagatgctagtaatttaacaaaaaaataaaaggcaacgatactatagggaagaaaagaaagaaaggagcggatgatgttacttggctattgttttcctaaaacaaaagcaagaaatgaagcatcttttaagagctggcctagaatgccattctgggggcttaggaaaaaaatcaaaatgtattagagctctctcagacattggatggtttatggcagcatctaaaattgctggtaaaattatgaccttgtaattcacagccgtgtcatatattctctagcacacagtgtaatttatgtaccaagccagttgcttcaaaaaagaatggggaaaaaactcacacaacacaaagtttataaaatgtggttatttttaatggataatgtctttagcctaaacctgtgttgttaggaggaagggtgtgccgttgctcaaggttattaccacagttcttgcagcatggggtgagagtatgaggattacttattacacttacgcattggctggccaggctaccatatccacaactacacagtcctcccttcctccctccctcaaagagagctatcaccttgaactccttcttcccttgaaataaaacctgggcaactaccgaagcttgaccttgactcatgccttaaacctgagcacaaaacttaacctctgctgggaaaccttcctccctatgaaacaaaggggtctcaagacaacttcttagcaagccaaaaatgagatttccactcagcttctcaagttagcctggctttgaccccagttatggagctagagaggggagaggagctgggagcaaactaggaatcatggagggggggactatggggaatatcagattcacacaactctcacttccatgaaaagggggaaggggagagagaggagactcccatggccgagtgatcaggtccagagacctccttgtggtccaggctgcacctgcaccagtctgcttgaccttgagcaacaagctatagtctctgaatcctatcaccctcacctataataaggagatgagctcttgccttcactacctaaaggagttactgtgaggatcaaagggtctattatagcttttaatcttgagccaatgactaggtcattatttttctcttgctctgcctgtatcattttctcctcatggcatacagctcttttgcctcaaagaagattcttgaggatgatgacctgcctcaaacttccttctccctaaaagtgttttcttttgttcagtttcatttctgtctttccacttattcctgattattttccctgagcctcttagagatctgatcacctcattgtataggagctatttacactccttctttgatatgaccacatgcttctctggatctgattcttaattctttgctacttccctccctgcccccaacccatgggggcaccagaagctgtgggaaaggaggcagcccatcgctaaggaggaggaggaccttgtcagggtgttggtggcgcaggtgaccagaggacagagctcactgctgtgatcctggagagggtgccaggacgctgttcccattaaaggcagtggggcttggagacactgcagcctcatgctcaggcctcctagactttggcccttgctgtggggctcgcctcgctgaaggcaggatgaagggcttatttttctggctgagatattgcatcccagaaaccacagaaatacttccaaaacccccaagataagagtgctcttattttgctccagcgtgaagaggagtttatttcatatgatcaagtaaagcaagtctggacgtcttccttatgtattttcaaaataattattttattatttaaaaaactcaacatattcatttaagagaaatggaagcaacacagaaaatgccaagaagaatgtgtccaacaaaccaaagcaaatatcataaaacatttgatcacattggataaagatcattctagatatttttctgtacagtagataagtaaataagttagacaaacagaaatttatataaaatgaacttgtactagcctcccgagtagctgggattacaggcacttgccaccatgcccggctaattttttgtattttttagcagagacagggtttcaccatgttggccaggatggttttgaattcctgacctcgggacccgcctgcctcagcctcccatagtgctggggttataggcatgagccactgtgcctggcctacatgtttttttaaaaaataaaactgttaagtttaagcttatttgtgtagtcacccagtggattttccctgtctgctgcacagacaaaagtaattcagtgagatggcagtattgctgtaaagaaagagtttaattaatgtgagtctggccaccctggaggactagggttatccttcaaatcagtctccccaaaggctaggaggttaggagtttttcaggatggtttggtgggcagggggctagggaacagggaatgttgattgcttgggggtaaaaccacaagcgtatggaaaacagtccactcgtgttgagtcctctgggtggggaccacaggactggctgagtcatgagtcttgggtccaggtggggtcagtcactcgccagaaatgccagaagtctgaaaaacatctcccagggccagtcttcagttctacagtagtgatgttatttacaagagtaattgaggaagttacaaatctgtgacctccagaacaatggctggttatcatttaactgcgcttatgtgttagcagaattcaggcacctcttataaccctaaccttatggcctttcgttagttttacaaggacaatttagttttgggaagggctattactgtccttgcttaaaggttaaactataaattcctcccaaagttagcttggcctatgcccaggaatgactaagggtagcttggaagttggaagcaagagggagtcagctctgtcagatttctcttgttgtcataattttgcaaaggtgatttcacttgaatgtagaaaaattggagaaaaatgaagcaattgctaaactttgtaacttttacctcctaagacatgctgatatgaatatgagaaagcaattaggagaaaagatgaaggtagagtcatgttttcatttaactttttttttttttttttttttttttaagatggagtctcgctctgtcacccaggctggagtgcagtggtgtgatcttggctcactgcaaactctgcctcccaggttcatgccattctcctgcctcagtctcccaagtagctgggactacaggtgcctgccaccgtgcctggctaatttttttgtatttttagtacagacggagtttcaccctgttagccaggatggtctcgatctcctaacctcgtgatccacccaccttggcctcccaaagtgctgggattacaggcgtgagccaccatgcccggccaactttgttttttaatttggtgtaaaacagatgaactttctgctgtgaaagaagagaaaatgacatttcattttctcccccatcctttcccctcacttcttagttatgtaattgtttcactgtgtcagggttttgtgacattctcttctgaggctatagctttcaattctatttagccttagtaaagtcttgcattttaaagtgttcagtactcacccaggttcattttttgcatagcatcttcttattgttttagttcagatcgtaatggtggaggaaccgtttccatgggactgagaagaaagacacttgtgttgacgttcaggcatacagggaatgaaatctcgggggcagcatgggagaggcagccagagccatggctgagcgtgcttccagggaggcagaacagggcagggtgagcacacatctggagttccactgcctaaatttcaaccgcggctccatcatctcattgctaggtgagcttcggcaagatgtttaagctctctgtgcctcaactgctgccacatctgtaaaatggggacaaccatggccaccgcatgtaaggtgttgtgggaataaaatgagtgatttaaaaatgattacagaggtatctgactcactgtcaatgtttgctcttgttatagaatcacactttttggagatcaatagcaggcaggaaagaattctctgagaatctcacagtcatctcctttctttagttgtttgcagggatcttttaaaatgtcaaccctttttcaatctgcttttgtggcccacctctttaaactttttccttcttcttagatggaaaccaagacctccttacggcccataaagcctgccatggccttagagcttctgccttctcctgcaccccccaggcttcttctccctgcctcagcaatggcaggcagcaacccgctcctttggatggcacttgcccctgcgtcccctgatggcccactctctcccttcagttctccactgatctatcacctcattagaaaggcctctgtggccacacagtctaaagtgtccctcactggaatttgtgtgttttatagcaatttatacaagcatttgcttgaagcaatttgtaattagttgtttgtttgcttcattgtttagttgtttcttgatgtgacttgtctgtactactaggccgtaacctacttgtgagcagggatcatgtctgtcttattcagtattttcatccaacacagagcaatgccaggcaccagcaggtgcttaataaatatttattgcatgaaatatctctgcctctatatatctgtatctctatatagatacagatggacattgcatattaaggtacctacctgtagagaggtagctacacagctgtctatatggatatagatactcactaagtggcctgaattattcaggcaacagtctttccatttcatcattctattttctctttatatgacaattatctaagtaatgaagaattggaatcagggctaggggtggttagaggaagaaatttgaaaggcaagcgacattcattgagcattagttggtggctgcacagtgctggatgttttgtgctgtaattcatttaatttctataataacctgtggtattagtccattctcacactactatgaaggaatcctccagaccgggtaatttataaaggaaagaggttgaattgactcacagttccgcatgcctggggaggcctcaggaaacttacaatcacggtggaaggcaaaggagaagaaggcaccttcttcacagggtggcaggacagagtgagttcaagcaggggaaatgccagatgcttataaaaccatcagctttcttgagacttactcactatcacgagaaaagcatgagggaaaccacccccgtgatccaattacctccacctggtcccacccttgacaggtggagattatagggattacaattcaagatgagattttggatggggacacagagcctaactatatcacctgtgaacaacagacattttctcattttacaaatgacgttgggaaagttaataagcaacagagctgggcccggagactcctgtccattaggtaatgctgcctctgagagaagcaggacttggtgagcactcagcaactttgggcagggtgcaacacctgtaaactccaggatgtaagttgctcatgcagctcccataaatgatttcaaatcacacgtgaaaaccattatgaatctgagaaatgcagaataaaaaaatcatcagggtgggtttgggttcattaaaaaaggaggtgaggctgggcatggtggctcatgcctgtaatccagcactttgggaggccaaggtgcttgagcttgtgagtttgagaccagcctgggcaacatggtgaaacccatctctagaaaaaatacaaaaaattagctggatgtagaggtgcatgcctgtagtcccagctatgcaggacgctgaggtgaaaggatcctttgagccctggagactgaggttgcagtgagccaagatggtgccactggactccagcctgggcaatagggccagaccttgtctcaaaaaacaaaaagaaaaagaaaaaaagaagatgaaatcagaagatttgggtgtagttaaggaaacatatttgtcagcagaattttgggggtgagctggaaattatggaatgcttttctgggtaaaattcaccagtctcaggccttcttttcccaaaatgtgcttcatggagtgttggattacactgaaagttggcatacattatttggaaagagaactctgtgctccagtaagtttgggaaatcctcatttaattaaagagtttcttaaccataagaatcctcagagccttccgtatgctaatgtgcattgtcagtttccaaggctaggaagtggcatttctctggatctataaggtctcaagatgcccttgagactgtattctacctgatgcatggctccaggggccttagtggggagcgccacattttccatgttctcatgacagcaggaagccctcagtgaatggaggtacagtgtgcagggtcgcaatcagtcctttccatccgccgcttcatttaagcctcacatcaacctaagacataggttttattattcctgggaggctggccctgttggtgcctgtcaccgcaacccagacccgcttgcccttacctgtagtgcaggtggctagattttgaattgccagcatctgcatttctttgccagaggactttctccagtcactgaagcttgcttgtgggcctgtctacaggtcgtaagtgctagggacttaatgcctcctcaaccagtgaccaacaggaggtgatggatcaatgccccagccccctcaccccttggtcgcaaggctcttctgtttacacataaagccatgtgtagatcctggctgccagagtaccccagtgggattttcctttagttgcccacagtgataaatgcttgataacaaactctttatggatgctttcccatctcctccccactttcctgttcccttactggtgtttcctgagatcacttcccaagttaactatttgtaatcaaatccttttctcaggttctcctgcagaggaaccccaactgagacatcccattttacaaaataatgacaacagcaacaacacacacacacacacacacacacacacacacacacacacacaaaagcaaaaaaacagaagagtctccaagaggttatggaaggtgccctaggaaacagcttatgcatggtagaaccaggacttaaatttcacaacacatttatttagcacctgctatgtaccccttgctatcctaaatgctgagatgacaagatgaaaaagacagtcttggaccctctgtcctaaaccataggcaaaaataaattagtccaggcctgtcttcaaagcctctgcccttaaccacaatactctgctaattctcccaggatggacatttgactctcttttaaactgggagtccatttccataccacccttatgaagagaagctgtggtattcagctcctattctgccctctaggccatgaaaaaactgcatcagatcaagacttttgattcatgaaatatgctagagaaaattgcaagatttcctgactcaatgattttcctgcccagtgtaacatctctcttaattagtgagttgcaattagcatttataaaaagaaatcattgcacaaggtgagtcaactgagatgtaacatcttgctctaaacactgtcctcctggtgtgagtgggatcattcagaaattaggtatcttaatcagctgagtgctccagcattcaaatgtatctggcccagctgggaggccagagtctgtggcatgcataagaagcttacaggagggagggagttttctgtgtacactagcatttgttcatagttgcaaagtagctgtagaaactgcagatttatggccaggtgtggtggctcatgcctgtaatcccagcacttcagaagggcaaggggggcagatcacaaggtcaagagatcgagaccatcctgaccaacatggtgaaactccatctctactaaaaatacaaaaattagctgggcctggtgactctcacctgtagtcctagctacttgggaggctgaggcaggggaatcacttgaacccaggaggtggaggttgcagtgagctgatctggcaccactgcactcccacctggtgacagagcaagactccatcagaaaggaagaaagagaaagaaagaaggaaagaaagagagagagagagacagggaaagaaagaaaggaaagaaagaaagaaaagaaaagaaagaaagaaagaagaaagaaaggaaggaagagaagagagagagaagaaaagagagagagagaaagaaagaaagaaactgcagatttatgagaatgattgttatttttcctactttggctatttttaaagttatatttctttgttattgagtgacctccagaggcagagagccacattataattatagaaatttgatctgaatgggatattaagggttatctattaccaacactcccagtcccttcttcctcccttccttctttccttccttttgatgagaaacctaatcacaaagagagaacatgacttgtctaaggtaacatagtgtgttggaatactcctgaaactagaacctacttagaatcaccagaaacttgaagttcttttgttattattatcttctttatctctctcagcggttctgacagaagaatgatcatgaagggaagtttaaattgtcagccaatgtaaggttttgcattatttatgcacttctgccatgtgggctatgctctcagcacttttaaactatccatagtccatagttggttctgataaatgattatttatttgctgtttttcagttttgcttttatttttggtgattgtttgtacttctttaaagcagggactgtgtcttacagtccctttctggccctaacagctcccagaaaagaacttaccatgtaatagggatgtggtgacttattgatgattaattcattttatatatctggattctttccctttgctcacataaatttcctgggtttgaaatttatgcctgtttatttcttctgttggcccctcatgttgtcagtgaaatggctacaagaacggcatttgatggaagaagaaggaagacagggatggcctatttcattctctaattggataatcagtccagaataatgatggtttgattttatttgcaaacctacacctcaggcagtgggtgaagaacaacagcataagcaacaatgcgagtatggtgttcatttacatcctcagtttgtctgtggcaggaagaaagaatccacttattgctaatgataaagtagtagacccactttatttattttcatataaatcatattgtggcagaaattttcatagcccgagaccaacttctggagtttttcttatctgtgagattgttcctgttgtgtatgagctgttttgcagagatcaagaatccctgctcaagtgtgatccatcttcatcagtgaagtcatatgctgcgaggacttctgagatactgtctgctgccacatgaccactaagcagatggttttgtgcctcttgcatgggttctatgaaaagatggagatttcagtgtccatcctctgtcactcaccagtagtatgcagaaatgggtgagcctaacagagttgttaggtcaacaaagcctgccattcaaattcagatcagtgaccttgcactcagggacaaattggggttaggatgcaggctgagattggagacggattatttcactatgcatgggtttgaccaggcagcccaacagcacaggtcttgcccatcaaaatattgtaactgcctaaaagagttggcaaaagtctctaacaaaacaaagggtttatgagctaagcccatcttgcattcatttcctcattccttctacacatatttagtgaaggccactctacactggacattgggatatgaacacaaagaaggagacaagtcacacagccatttatttataggaaaaaaatgttgaaataaatacatgagctgaagactttagaattacaaaatgagacttgctaacttgttttggattggaagaaattagtttatgcccatgacatcgctttattccagactgattagaagcataatgtacatggcaggggcagggagaaggggatgacaatccattctttgaaagagactcttctccccttaggttaaatagatcgtcaagtccttgcatgtcaaaagcagagatgtgaatcactgtccttcagaaagggaagaaaacactttaagcaagtgcaaagttcccagctgtgctaggcacgatggattatacccaaagaagttggacagagaccttgacctcaaggatttcatcgtctatttgaatagaaatgatttctatataactgaattaagccagagcaataaaaatagcatgatattaggttctaaagtgagtgttgcaggaaacagaaggaacttccaaatgttgttatttacagatttctaccttgtgaaatgtagaagtacctgttctcaaattaaacattccttcctcatttcaagatgtcagctacatcagaggttgaccaactatggcctacaggctacatctggtccatcacctatttttgtaaggaaagttttactggaacgaggccaagctcattcatttttgtatcatctgtggctagttttctcactccaatggccgcattgagcacttgcaatagagattgtgcagcttacaaagcccaaaatatttatgatctggccctttacagaaaaaaattggcaacccctgatttagattatccaggttgatcctggtgctaatttagagcttcagaataaaacacagctgaggtgtgcctggtagcaaattaatcccccccaaaacaagtacttcattttccttaaattaatgttgagcatcagaattaaacagagctaaatctcatgatacctgaggcccttgtgaaaatgtttttgctgacccaagattcagtgttatgctttctgtccttacagagagctaaatcaagagtccccttttggaaggagtacctctgttctttgtaaactgtaattgaagatataactcaccgtgttcttcagtctttattcaaagccgctggcacaaaaattctgcttgaatttaattttaggatagatttgatctctgaattggctttataggttttctcagttcacaataatcataacctagttgtttctctcttgccataggtgacaggcaatgcagagccaatttcagaagtgagctcagtagtaaactcatggcaggtgcaggatgaggcaagagagaggcctgggtgcaaacatgagggtggctcattcccagggctatgcaaaggcagggtcagtcccaaaaggagcacctccttacatgttgtgcctgaagtgtccctttctcagtcttttcttggtggtggcaggtgctgcctggcaatccccatcccttctacttttagatggtgggggccctgtcctgctttatccttgtatatggcgcttttattttaaccatgtaaactgattcaggtcctccctgtagtcaacagagataaaagtctcaataatcaaacctgtgggtacttcagtgaccagggaccaccatctgtcccctgtgggtccagacatcaggcaggaggaaaagttggggccatgtgtcagcgtcccagctggggctcaccatgggaagtgggattagggaggattattccagttctcttctttgagttcaggtttttatctacgggaagaagagggagattggacgaggttagattcacttgtctccaatgtcctgcatggggttctgggacagacaatgcctcagaaatgggaggtccaagaggatggtgactttcactgctagctgatgatgaaagggaaagggatgagggaagaatgggctgaattagaggctattccacccctctgatggttagctttcagggggaagggaaggagggagggaggctggtggggtgggagacaaagacgaattggagattaggaaagattctttggaatagtcaaaccagagaccaagcaaagcatctttttcccttgtaacttgagacctgtgcaaatgacacaggcttctagttcccaaacttaataagagtaagtgcgtgaagaagagacctgcagacacttaattcaaacagtctagaattctgggaataagttatagtacaagttatatgtggctggttatagattcagccttgatgtttatgttccctgtttcaagtcacacacatcagattactcacttgtcagctaaaaatagggccatcactggcttgcaagtcgagttaggttttatttctctatgtgcttcattgttcgttcttttgtgctccctcctctgtgcctggccccctctgccatgcccaggtggcttcacagtcccccttccccatggtcaatacttctttctaactgagggataaatgactctgaaaaggaaatgtatttcaatggggaccaatccattacacccgagagagagaggccaagtgcagggacttctggaggagaccaggaatgagtgattatgtagcatattctgtgtgaaaggcattttaaaacacacgtagatcaatttattgtcacagcccctgagaggcataattctcatcttttttctttctttctttcttttttttttttttttttttttttttttgagatgaagtcttgctctgtcacccaggctggagtgtagtggcaccatctccgctcactgcaacctccacctcctgggttcaagtgattctcctgcttcagcctccccagtagctgggactacaggtgcaggccaccacgcctggctaatttttgtattttttagaagagacgaagttttgccatgttgactaggctggtctcaaactcctggcctcaacctatctgcctgccttggcctcccaaagtgctgggattacaggcatgagccaccgcgcccagcttctcatctttattttttacatgcagtcatagacattcaggtttcatataagcagccagggtctctcagtgcatcaggagcagagccagggtcaaaacttacatccatttgaacccaaggcacagttttttcttactgggtaatgctgctgtcttatgggggaattttaggcatcaataaacaaggaagagaagaaggctaatttcttttgggggctggtggatcgtcccctaaaattatgtagatagtcatctttcctatcttagctaaatacaaatgtagattgtaaacagctcctcaagactgtacattttttgaggatagatttagagcaaatcacatttgtatccccaatatggttagcccagtatctggctcctagtaataattatagcaagcactgactgaacatttcctatgtgccaaggacaattttaactgttatagatattaattcattcctcacaataaccccatgaggtaggttactattactgttcccattttatagttggggaaactgagatactttgagttgaaggaacttgctaatgctcactcccaattaatggcagagctgggatttgaatcctataacactgggcccagattccgtctcttttctaaataggtactccatgaaaatatgttgttgaataaatgtactattactttgtacagggttgagggaattagatatgacttcactgaagaggtcaatttcgtctgagttcatttcttggtcaatatttttaaatgaatgaatggattccagtgtcctttttctctgaccacttctgtctcagaaaaacaagcctaatgcagaggaagaggagcaagggagttttcccagtattggtagatgaagatctatgacttcagagacaaatgaagccctcctagaattctttcaggcagacaataccaggtggcaccatgggacacactggtgggaggagtgcaaaatgaggatacagtttatgacagttttttttggaatagacacatgtccagagaaatgggcccacattcacttgtatgtgtgcatacgtttgcatagaattctcttttaaatatttcaaatttataagaaatcctttcttgtgatgaacagatttatcttgaaaagtgtttcccattttaaaagtcagagacttgaggcagggttggaataacttccaagagcatgtggctcgtatgtggagatgccaggaaccaaatcccctgctgctggttccagggaccacatttattgccacacctacagggtcctaggaagaggctggcagatgtgccccatggagataggtggggtttttatttacagtaggagaccagattgcccagtgatgatggggcattcgatggcagaatatagaccagtttgactgggccctagtgctttggcagatttttggaggagaatttgctgagtgtcagaccctgtgcagagctttgcaaacatcgttttctttaatctggatagttcgtctgtgaagtagatgtcataatccctatttcggagatgaggaaatgaggctaggagttacataacttactcagatgtgcagctgctggtggcagagcctgaatacaaatccttcacttctccaattaaaccagccatctctgagttgcaggggtttcatgccatactgcccactggaagttgggagggaatttacagggttacagcagatgatctctgtttaggcatcaggtgaaactttagtgttccctaaattggtacaagcagactctgtttgagtatctctgttgacagggagataccatctaacatggcagcccatctcaatgtttttaataagtatattatacatgcaataaaatgcatagatcctgagggtgcattcagtgagttctgacagagatatgcaccactgtaaaatggtctgtcatccatatcaacatagagaacatttttactatcctggaatgtttctttatgctcatttctgtcaatatctgctctctcctcccttgaacataaaaaaatcactatcttggcttcaatcactatagattagtcttgtctgctctcaatttttgtatgaatggaatcatgcagggtattcacttttctaactagctcctttccttcaaaataaggtttttgatatttgtatatattgttgtatatattaataatttcttccattttattgctgctaatattccattatgggatataccacaatttgtttatcaaaccaccctgttgatggccattaggttgtttccaactttggcttattttgaataaagctgttatgaacatccttgtacaaatgattttgtggacatatatttttttttcttgggtaaatacttagaaattgagtctctgggtcataggatagatgcatgtttaacattacaagaaactgccagttttccaaaggaagatacaccattttacacttctactagcaacgtgtgagggtgccagctgctttgtttcttcaccaacacttgataatgtcaacttttaaattttagccattctaatggatttgtggtgccatcttgttgtagttttaatttttatttctgtaagttctttgtcatataaatgtactgcaagtgtttcctcttaatctgtggcttatcttttaatttattgtctttttatgagaagttttttattttactgatatttaatttatcagtctttttaaaaatgtgagtgccttttgtgtcctatctaagaagcctttgcttatccgagtgtcctcaagacactctgctgtgtttgtttatagaggcttcagatttagcttttacattgaagtcagtgatccatctcaaactaattttgtagattgtgttaggtaagagttgagactgatttctttccctttgtagatatccatttttccttccatttgtggcgatgactttatttttctcattgagttgtattggtgcttttgttgtaaatcaattgattgtatatatatgggtctatttctggactctgtttcattaatcaacttgtctttttggggggcacgacacattatcttaacacaacatagtttcattattttttgatgcctattaaaatgatcatatgatttgtcttttaatttttcaatgtggtgaattacattaattaattttcattttttaaaccaatcttttactcatgggataaactctatttactcgattctaaagtattattctttttatatactgctggattcatttgactagtatttatttaaggattgttgtgtctatgttgatgacatatatttttctgtaattttttttcttttcataatactcttattaggtttcaatgtcatgattattctggcattataaatcaagttgggttctcttttcctccagtccctgaaagagtttgtgtaatattggtattatttccaccataaatatttggtagaattctgcagtggaaactgcctgaacctgaaattttctttgtgggaatgtttttcattgaagtttccatttatttaacagatatgtagctgtttacattttctattttttcttgtgtcagttggagaaaattgtatttttaaaggaatttgttcatttcatcagggtgtcaagttttggagacataatattattcctaatactttaaaattatcctcttagtgtttgtaggacctgtagttctgtctatcatttccagacaactttaggtgttggagagttagtttctcaccaatttctttttaaacacattgagtttctttcaagtcaggaccaggccatctacttccctcttcaagatattcgtcatgctgttccctcggcctaaaaaaattgccatcaccataatttttttacctggctgtctgctactatatcattaggatatagaattattgtgaagcccttttgcgtatgtatgtcacattttccatacacattcactcagatacacatttatgtaacatacacatacacatactcagataactacttggggtttttcctttttcttttttgttttctttttttcttttcttttctttttttttttttaaatggagtctccctctgtcacccaggctggagtgcagtggcactatcttggcttactgcaagctccacctcccaggttcatgccattctcctgcctcagcctcctgagtagctgggactacaggcacctgccaccacgcccggctaatttttttttgtattttttagtagagacagggtttcaccgtgttagccagaatggtctcgatctcctgaccttgtgatccgcctgcctcggcctcccaaagtgctgggattacaggcatgagccactgcgcccggcctacttagggtttttctttacagcactttaaccaaattgttaattacagttatgatatattgtttcactctctgattatactataaatgccaccaaggctggacttgtgcattgttcctgttaatcagcaaatacccagtacccagcaaaacgcttggcacataatagatgctcaatacatcatggtcaggtgaatgaactaatccacattgagaagaaatgttatgctttgaaaattctaccaataattttagccttgctagaggtctgaaaaaataggtggggattaaattatgaggagcctcagctaacaacttgtggaatgtggatattttcctgtttatatttttaatgtttcccctctctctgtctgtgtcatatttttgtttacactcagtaccctgggaagggagactttcatagtcactctgggctgccttaacaagatatcaaaaactgggtggctgaaataacagagatttattttctcacagttctgaaagctggacatctgagatcagcattccagcatggtcaggttctggtgagggctctctttctggcttgcaggcggctgccctctcactgtgtcctgacatggcagagagggagaaagagcaaactctctggtctctcttcttataatggcactaatctcatcatgagggccctatcctcatgatcttgtctaaacctaatcactccctaaagtacctcatctccaaataccatcacattggggtttgggcttcaacctacgactttggcagggatgggggtccataatgtagcctgtaacagagaactaagagggggctggggttggtaatgagagaagatgctgaaaacaatgggacaaagaagcagggggtgggccaaggagctctaatgagtgtctcctcccatcttcctctggatagcccagaatccctcttcttcctcagtcctgtatgtaggattagcagaggatttgcgtatttgggttatgttagtggtgggaggtggccacgacaggaggagtaggacaattcagtttttctttcttgttgggcatcacatcctctaagggaatcctccttatgagtcctcagttgttaagcaggattactaaaataaaagaaacgacttagtgggccccaaactgcagcctctctcacactctattctataccacttgatttgaggaattatagccttttctctttctatccccctaaaccatgtccaaaggagcttacatggttatttccagcgtgaagctgattgatcagctcgcaggacatcgtggatcagagtgcttcccccgcccctcttaaccgcctttctgatgtggctgcgtgcatccagtgcccagagcatgccggggttcttgcaagagggactggagggtgagggaggagagagtgtctattggctccaccaggacatagatgctggtgacccacactgcgctggacaggaggacctgtttgcagcacgggtcagaggaacacaggctcctccaggtctttccagagcattgactcctgcaagaagtgaatggaagggagccgaaagcctagcccatctccctccttctaccatgatccccagtaagattctggtgtaccgccacccatccagcagaaccggcacagagctttacagacccggcaggcgccgcaagaagtccctgggggacctgttccataatggctaccgggtgaagtctgggcctgctgctccggagaaggaggaaccgccgaacttccggcagtcattggtgtcttgctgtggtgtttgtgcatcctggggtaaggactcacccgtccatggctcttctcctcccaaaagtattccgtattcctggaggctgcctgggaaaaaaagtgctttccgtctaggctggatttggggaactgtctagtggagaggtgatagccaccttgattcctgttttcttggcatacccacccaacgcagatgtgctgggtgaggcagaaatctcgtccttcctttttagatgaatttaactggcctctagtgctcctgaatgttattgagctattaaagaatatatttcagaaatgtgggagaaagtttggcaaacgatgtaatagcttgcttcctatttattaaatggcaataattttcagtgagtcagcatttttggaagaggcatttggacctatcgataatttttttttcaggggctacagtgcgagttgtggctcattttctgtccttacatttgaccatgggagcgtggtcttgcctgtcttgggtggtacttttttattcttacccagcagagatcataagaatagttttctaggcagattttcttttctcaactgctttctgataggcatttggctttatttaggcatccataatatattacagtttaaaacaaatagattaaatgtacatttctggccataaaaatgtcagtcttagggagggatagcttttatttccaggaaagttagcagtactaggaatttctttaaaatggaatgtagtccctttgaaacctagtttaggattctgatgtgggtaggcacagctcaaatacttctgcattatgtaattgtgcctaacaaaattccagttggcaagcaataagtgaaacctagtcaatccttttcattagaactgatataaaatgtttctgtcagctgaaatgcctggaatctaaatattcatgcttctgtgtctataaccctagaattagctggccagattgttatatttcctctcccttcatcacagagaagagctgctctgtactgtaacatctggccttggagagaatcaggattaaagccactagagagaagagaccaaatgatggaattattaagctaagggcacatacactacttcctgagaaaacgttgaataattgagtaaaaccatgggtttaacttagtatccaatacccttcttacttttcctttgaaaggattaatgcatttattaattttcagtagtgagtactcactatgtaccagtcatcactgttctagaagagggtgcacttggtagtgagccagtgagtgagacacctgccccaatagagcagatagtctgctgaggaacgggcaggaggcaggcacctgaacaagcaaatgagatcattttagattgtggtaaaccctataaagaagaatggataatggcggcgaaggactgggctccagatcgggtggtcagagaagacctccattagccaaccttgcaatgatctgggggaagaacattcccaagaaaagaaacagaagggaagactcagagctgaggacgaactgggaaatgtttctggagcagagacactgtgtgcagggcgtgaggacatggagagtggtgatgaaatgagcagaaaccatggagagccttccagagcgagataaggaatctgaaagtaattttagtgagatggatgccatgtaatggcttttggcagggagcaatgtaatctgatggatatttgaaaagaccatgctggctgctttctggagaatgctggtggggcctggggggactggggtagagaagtgaagcaggaagacccgtgtggggctcttggtccagatggaggtaacagcagtgtgaaccatggttctggcagtggagagggaaaagataagttatttcacatatatttaagatgtaaagtcagaccaggcaaaatggcttatgcctataatcccagcatgttgggaggctgaggtgagaggatcatttgagcccatgaggtcaagactccagtgagctatgatcatgcaccccaggatgggtgaccatgagacactgtctcttaaaaaattcaataattttaaaacaaagtaaagaggtaaagtgagtaagtcctatttgtttacttttaaaaaatgtgtttctctacttactggctcctctattcaaatagaagacctggaagcaggagcctcacccctgtgctgcagcatctggaaccacaaggggtggtggaagcagtgactctgtgcatgtgtgtgggtgaatgaatgaatgaatgaatgggcgacaatcccagtctgaatatcaactgatgttgagcatctatcagaacaggaaccaggactgggttaaggtagggagccaggattggcaacatggtgaaactgtgtcactaaaaaaatagaaaaaattagctgggcatggtggctggctacttggggggctgaggcgggaggatcacttgagcccaggaggtcgaggctgtagtgagctgtgatcgtgccactgcactccagcatgggtgacaaagtaagaccctgtctcaaaaaatttttttaaaaaagtagggagcaaaacaacctgaacaattaccaaaggaaaggatggtgaaaaggtcagacaagcaagaactgtttatagaacacacattctgactgtgggaacaaaagcccaggggcatttgagaggaagcgagacagtcctttttctccagctgggaaggagaggctcagattcactctgtgctggggctaagaagcaggtggtcctcacagtgaccaagctggggatgggaggtgggacctgtgatggcagaagggtgcaggggaccaccctgaagaagcctccccatgctcctgggcatcctctgtttaccctgatatgcctgccctcagtttgatccctctgagctgcaaggccagataacaatgaccttgtcagacaccacaaaaataattgctcttcaggatttgcgtggggctgcagggattggaaacgacagacgtttattggaacctttcagctttttggatttaaagattaaggagtgaaagggaatggaaaatagcaaattggaaaaccctggcaggctttctggtatgggcttggatgtgtttgctgttgtgttttctgtcttgtcctctcccgagacctcacatgtatgaatctccagagtcttttctctctggggatcacaggaaccctgaagcagtgaatgagttatcatttacctgtttatccctcaatttctgtcagtacagtaactctgcttttatctgagaagggagttcaagatcccttaatctgtctggtcattgctaaaattccacagcaatagttctcaggaggagcctcacctagttgttcaggccctgggcagcaagtttcgaagggaaagctctggcagggggtcctcctcacctggagccaatggtctcatgtgactgaatcttgcatgtgagtacagggctcggagccaggaaaacctgtattccagtcctgacttgccactgactttatgactacagcaataagtaattatgcataaaaatagaaattttgatataaatattacaaaaaaattaaaaaactcaagaatattaaagaaatccaaaatgtctgcctttgtaacatggccactgtcatcattttatgcttttcttctactttttcattttacacatacctatagttttcatagttttatcatagggaccatgcacttcatcttttacttcttttttttttttttcagcatttccaatttgctatttttaaaaaattgtggtgaaaaacacataacataaaatttaccattttaattatttttagtgtacagttcagtaatgttaagtatatcctattgttgcaaaacagagctccagtactttttgatcttgcaaagttgaaactctaaacccattaaacaaataatttttcctctcccctcagctcctggtaatcgctattttaatttcgacattctacttctttaacttaacattatgtcaaaaattttccttgttacaatctttgagcatatataatatcctataaagaagatgtatcagacgtaagacctatttttggattttaagctgctttctatttttcttgcttaatgaacaattttgcaatgagcatctttgtttctgtagcatatttccatattttgttatattttcttaggctatattcccagaaatggaattactttgattaataatgctgaattactttctgaaaaggttttatcagtttataattccacaatcgaattataagactatttcattgtagagtcatctccactaggtgaagctcaaatatgttgctattaagtagaataaatacagtgcttacttatttttgtttaatttgcatttcttttaattttttaaagcatttttcaagaatactatatggttattaactatagtcaccatgttatacagtagatatcttaaacttatttctcttatttaactgaaattttgtatcctttgaccaacatctacccaaccacccttccctccaaccgccccagcccctctttctatgagatcagctgttttatatgagtgagatcacgtgatgtttgtcattctgtgcatggcttatttaacttaatataaactttaggttcatccacattgttgcaaatgaaaggatttattcttttcttggctgaataatatgccattgtgtatatatatcacattttcttcattcatctgttgatggacactgcggttgatttcataccttggctattgtgaatagtgctgcaaagaacatgggagtgcagacatctcttcagcacgttgatttcatttcctctgaatatatacccagtggtgaggttgcttgattgtatggtagttctatttttgggtttttgtggaaactttttacctttttccataatggaaaatagtactaatttaccttcccatcaacagtatgcaagggttcctttttcccacatcctcaccaacacttaaccttttgtcttttcgataataacccttctaacagatgtgaagtgatagttcattgtagttttaatttgcacttccctgataaatagtgatgtcaaacattttaaacatttactgttggctatttgcatttcttcttttgcgaaatgtctattcaggtcctttgcccatttcttaattgggctatttgctttcttgctattgagatgtgttctctatatattttgaatattaagcccttatcagatgtatagttttcaaatatttttctcccattctgtaggttgtctcttcactccgttgattctttcttcctttttttttttttttttttttttttttttttttttttttgagacagagtcttgctctgtctcccaggctggagtgcggtggcatgatctcagctcactgcaatctccacctcccgggttcacgccattctcctgcctcagcctgccgagtagctgggactacaggtgcccaccaccacacccggctaattttttatatttttagtagagacggggtttcaccgtattagccaggatggtctcgatctcctgatcttgtgatccacccgccttggcctcccaaagtgctgggattacaggcgtgagccactgcgccccgcctctcttcactcggttgattctttcttttgttgggccaagctttttagtttgatgtaatcctctttgtccatttttgcttttattgcctgtgttttaggggtcatttccaaaaaattattgccctgaccgttgtcatggggctctttctcaatactttcttctagtagtttcacagttttggatcttaagtcattaattcattgtgagttggtttttgtatatggtgcgcattttttttatttgaaccaagttaagataaaatagtttcatttaattaatttatttaatgattattcactagttatattatctacttcatgatgtagctgtttgatttttgcctacttatcaactaatgataaagtattttacatacatgcttttgacattacaaagaatttatccttattgtatcatatttgattattttttcattggatattgtgtttattatgattttaaacatgcagaattttgacgtttttatggtggtggcagagcctgtatttcaaagattgtatgactccttttacacatgaaattagaaattcttcttttcagagggctaataatatatacctatattttcctcaatttttctgtcccttattatctatatttaatttttaattcatctcaaacttatttccattatggtatgaggtccatcattgcatgatgcctgtcttccttttgatttgtgatgacctctttattgtctgtaaaattcttctgataaaatagagtctatttctctactgcttagtcattgttgccatgctcttattactttcttattctattgctttgtggtaaatgtgacttagatgatttttgcattttagattttgatgaaatttctttgtggcctaatatgtggtcagtttttgagactgctcatggctgttattaaagaatgtgtgttcctagtttactaatatatgtgtgtgtctttctgcccatccattcagatacatatagatacgaatatatcccaagggattaaatgctacttaaatgtcctatatttgtgcattcttgtcatatttgctttatttatctcaaaggaatacttttaggtgtataaagtttttttttgttacacattctttgtggattgtttcttttatcaatatgagatattactttttattctttttaatataatgtttatatataatttttatataactttttgcagtagctgccactttatttgatatagtcattgctctatttgttcctcttttctcagcatttgccaggcacataatttccattctttcatttctaacttttctgtatgtcttgtttgcagtgtatgtcttttaaatagcatgcgcctggaatttattattgttgttgttttcatatcatgtgaatctctgtctttccataggtgaaagtaattttaatttaattttattatgattacaaatatatttggactcttttgctattgtaactatgttttctgattaatataccttttattttttttttcttttcattggatgggctgaagtttttgttctttttttcttttctccatttgattaaattcctttgtccttttttttttctctaggctatggaatttatatccttaaggttttgatacacatactttaatttttttctgttaatatatatgattgattgtatcctatcaagacaagaatttctgcacacctttctttttcccattgccctctctccttcacacctccatcttccatttatttccagagattttaattttggatcattgttattatttattcatttaaaacatactcagtcaacacataaatgaatccattacttttatcttttccatgttgcttcttgtatcttgcttcttttggatttatttttctttcaactggctaagtatatattacttggttcaaattaatctgtcctgagaattgtaaagatatccttcttttgttttcttgcaaccagtgaagccaggagaattgtgacaataatttgactcttgttgctttgaagggatttatttcttcacattgatgttataaaatttatccacaatatgcttggatttaggtctttgaaaatgtaatctgctggccgtggggcggagcttgcagtgagccgagatcgcgccactgcactccagcctgggcaacagtgccagactccatctcaaaaaaaaaaaaaaaaaaaatttaacctgctggacacttaaaagacctttccaatctgaggatacaggtcattctttcggtctaggacactttaatgttattttaaatgtttcctgttctctatttccttcattttttccttctggcagctcaattacatggatgtggaaaactttattcctgttttctgggtctcttagtttttcttttgcacttttcattcctgtgcccctttgtatgaagatggctgtgtgatagttcagccctctactttgctgtgtggctatgcccattcttctattaagctggccttttaagattttgatgttcaaaattttaattgctaagatatttagttgattttttgagttgagatagtttttcacaactctttatatttttcaaatatttttctaaagcattttttgtttaatgctttgttaatgttgtatccttaagggtcagttggcctgaagtgtaatatgtgcatttcttgaaggaaagttgcctttcctcaaatgtttggcaattctttagttcttttcttcccttttcttttctttttttttttttttttgagaccgagtcttgctctgttgcccaggttggagtgcagtggcgcgatctcagctcactgcaacccctgcctcccgggttcaagcgattctcctgcctcagcctcccaagtagctgggattacaggtgcctgcctccatgcccagctaatttttgaatttttagtagagatggggtttcatcatattggccaggctggtctcgaactcctgacctcaagtgatccgcctgcctcagcctcccaaagtgctaggattacaggcatgagccaccgtgcctggcaacagctggataaattttcacgaagagaatgcatttgagaagccaacgctcagctcaagaaacagtcattattgcctgtcaccccctagtcccttctcctggcaaccttctagtcactacaccccacaaaggtaaccactctcctgaccatatatcagttttgcccagttttgaacttcatataactgggttatatagaatgactctgtgtcaggccttgttctctcagtgttacgcctgtgtgattcatccatgtggttatatgtagatgtacttgacagtgtttttttgtttggagatggagtcttgctcagcctcccaaagttctgagatgacgggcatgagccaccgtgcttggcctgttttgtgcttatctttgcatttgagatcttctgttagcctatatgtgaatgctgtctttgtgtgttgcagtttgtctggggagtactgagatatgctactgtgtgtttctattcggtaactggtcttacagctgtagagacagtgtgtttcttccaagagttacagtttactcaggatattgctctattttaacacctcaagtgtatgcacttgctgccatgtagtgactactcctgtttggcaccccagtcaatcagtgttattgtcacagcctccttcttcccagggtcagccacttcatttcaccttttggatggttgttttcttcttcactgtgatctctgcatcccaaccacccccccatcaacctcagtctttatgtattgaccaaagacatttttaatattctgtttatcattgtggagatagacatatgtgtgtgtatatgtctttctttctcattatggaaatatatacatggaaaatatatgtatatgtttatataaatataaataaatacatatatatgtatgccaagtcagtttctaacagagtatctacccacattttgtgttcgtctgttctgtgttgtaatctcctcttccattctttttgttcttgtgggattctgctgtttcctaccccctcaacatttgtattagtttagtgaagttttgagagggggcagacataaaccattgtgatccatctgctatgtttaactagaatgctctggattatcattttaattcattgatgaataatttatgttggtattatatacagaattttggcatctatgatcttagtgatattagaatacagatgcttctcaatttaaccatggagttacatcctcacaaacccatcataaactgaaaatattttaagtttgagaatgcatttaatacccctcacctaccaaacatcacagctgagcctaccctatcttaaacatgctcagaacacttacattacctactgttgggcaaaatcatctaacgcaaagcatattttataataaagtgctgaaaatttagtgtaatgtattgaatactgtactgaaagtgaaaaacagaatggttgtgtgaatacttagagtatggtttaaggtgaataggtatcacttttgcaccactgaaaagtcagaaaatcattaagttgaaccattgtaagttgagggccatttctactttatttttgtgctttgagagtcagtttttggtcctcagtttatgtttattttataatataagttagtagctttagatctcgttttgtattatggaacagtttagaattttaataaaatgtatgtgcaataatttaatcataaattatatatgggtgcagagtctgtaagggaagctgttactatatatttcaatgtatatctcaattgttatcctataatggatttcttttttgtgtgtatcaagtttcgaagtttatatttttcagaaagtcatccctctcactgaggtttttcacagatttattagaatatcattgtggataatttttttctttttttattggatcagccagaactttattttgtttgttttcttgttgccattgtttgctcccataaaattctacagatttttaaaattttttttcatatttattggttttctggttatttagtcataaacactaaactaaaaaatcagctttctcctattgtcaagactacttttcccccaaaatcttaagctgaatgctttgttttataaataatctcttattgtattattgatttaacttctagttagccagtatgttctttaaaattgatttaaatagactggtagtgtgcttagagggtagattactggttttaaattactcaagtgattactcggattaacggaaatttgctatttggagaaaaaataaagcattctccttttggcatactactagccaaaataaataaatacatcctgatggattaacaagttagaggttaaaaaaagaaaataaaagatactctaaagcagtgattcccaaacttggctgtacactggactcatcctcatccatcatctggctgtacattagaatcttcttgattagaaaaataaagcttggtccttttggtgcactgttaaccaaaataaataaatacatcaaaacagattaacaaattaaaggttagagaaaagaaaatatattctgaaccactggttcccaaacttggctgcacactcgaatcagaatttataaaaattctgatgcccagcttgtatcccagacccgttgaatctggtgggaagcaggcctcagtattgctttaaaatcctcgggtgattgcaatggcagagaaatctggggaccactgccttgcagccttgttttcccaaagtgtggtcttctgaccaacagcattgacgatagcttagagcttgttagaaatgcacagtatcaggccccatcggagacccactgagtcagaatctggatgtttacaaatgccaggtgattcatgtgcacaatggatttgaatcccatgcctccaaagcaagtgtagaaaattagtgtccatggcctatttatatgaataacattttactggaatatggtcacacctatttgttttcctattatttacagcaaagttgagtcgttgtgacagcctaaaatatttattaatatttactatatgttcatttatagaaaaagtttgcaatgcttcttaacctggatggctcattagaatcactctggagccttaatactccctctgcctgaatgtaccccacgcccattaaatcagaatgcaggtagggggtgctgagacccaggtgtcaacaattctaaaagtttcccaggtgatttaaatgtacagtcaaagtccagaaccagtgccccaaaagtacaaagaaaaaaaaatagatgcagtaaaaaaaaaaaaaaaaattatctatatgatggggatggccaaaaaaattttaaaaaaagggaacatggtagaaagattgatatattttagaattcatggggaaagaaacccaccttaagtaaaatttgacagtaggaaaaatactttaagccaaattgagaagaatgacgaacggtgggagataatatatggtatacaaaatcttctttatatgagaacataattgtattactacaattaagataaatacacaggcagactggcaaaggccactctaaagcactttagagaagaaaataaaatgactaataattatatgaaaaaataattagcttcatttgttaagatagaaaagcaaaataaaacagccatgagctcttatttggggtctatcaaattaggattttttttttaatttttaaatttttaatttttttgagatggactctcactctgtagcccaggctggagtgcagtggcgagatctcggctcactgcaacttccacctcccaggttcaagtgattctcctgcctcagcctcccaagtagctgggattacaggcacataccaccacacttggttaattttttgtatttttggtagagacggggttttaccatgttggccaggctggtctcgaactcctgacctcaagtgatcagtccacctcagcctcccaaagtgctgggataacaggcatgagccaccatgcccgacctcaaattgggattcttaccctcgttctctccctctttcccctcctgccttcctgccttcctgccttctctccttctctcccttcttgccttcatgccttctttccttccttccttccttcctattttctctatcactgtactcaatccagtgggaatacaggcaaaagagcatttgcatactgaagggaatgcaaattgtgaggacaagttggtaagatgtatcacaagtcttgaaagtgtgtgcttgagtcctaatgtctgaattggaaatgactggctgaagtctgtacagggcagtggctagaagcttgggctttgtggagtttgtcacatttgtggtgaaacttggctctgttgctttcaaactatgctggatacactgtctcatttgtgtctccttagctattttcttctgtgtacgtattttttaaaaaagatatagttagaagttttagtgtgtgtaagtaaataaacatactagatatcatcaataataatagattaatgtcattgtcaacatcatcatttcaccagtaatttaaaataatagtaacactatatgtactctgtgtgtgtgtgtgtgtgtgtgtgtgtgtgtgtgtgtgtgtgtgtgtgtttgtgtgtgtgtttctgggctttctagtccagtttgatgacttttctgtggcgtgtgtacactcctacgctattgtaattcttcatatgatgaaattaccatttactgagtgcctccagtatgcccacatggactcttagaatgctcggtcttctggtatgcagatcaccagggtaggatttaatgcccatgcctgtgagggaataagggtggagaactcaggctggctgcagctgcctgggaagcctcaacccatcccacaggaaaaagtatcccaaattgaggcaaggcagctgacctttgtccctacatcagccagcatttgtgtgtggtggtggggggggggtggtcatccacctgagaatctctaattcaatggttagctcataaatcttccnnnnnnnnnnnnnnnnnnnngggatgtagccccaggtgaggcagctccttgtagcagagggcagttctcatgaagggactagctctgagcctttagcaggtcactcttcaagagcccaggacaaataaggtccctgaagaggggatttgggctgtaccctacagcatctgctatagctcatgtcttttattcatttaatgcagtcttggatatgataccctagtattttatttaggattattgttgttagtcattagtgtgataagcttgccatttaagaaaaaatgcaagggaacttgtgtccaggtaatgccaactttctaaaccaatacagagcatggaaaaacacagataagtccatttttaagaattgatcatataatagagaatagatagagaagttactattttttgaaactgtaaaaatctcacttgtaaaactctctgaacctggaagcttttggggagggcatgtaattcctggcttttggtatatacacattttcttcttcacaactctattatagctattttgtgttaccttagaaaatcatttatttcagagattttatagaataaaaataataaaagatattataaaatagagaagatgaataattgtcaccaaagagttccccctctcacctctcttatcttggtctcctctcttagcctgaagtcgctgtctgtagtcttctgggctctttctgggtatagccagagtggtcattggttaaggcttttccctgatgaggctactttctacttcccaagagtgcagccctgacctctctcaggggaccccgcagggcttctggcttttccctttagtaggcaacatatagtctcagaattctgaatgtggattatctaacctttaactccgccgtctaattatttctcaaaactttgattcactcattcagttcaagcaaggatttattgagccttcaccttatgccagacactatgttcaatgctggaaatatagccctgaacaaaacagacatcagctcctcccctcatagagctgatgctaaagagaggaaggcagaaagtaaccacataaccgaggtgctagtgcttcatgctgaggagaaaagtgaagcaggaaagaggatagggagttgcacgggtggtgtgggaggagttgcatgtttaggtcgggtagccagggaaagtcacgctgatcaagggacattgagtaagaacccaaaggaggtgagggagtatgccatgtgggcatctggcgaacagcattccaggcagagaggctgcatgtgcagaggccctggggcagtagcatacctgtgtgttcaagtgtcactgaagacatctgccagatcagcggacagtagtaggagtgacagtaggaagccatcagatccaaaaggagatagtgctggtggtgggatggtgttgctttaggcctttgaaagactttgacttttactctgtgtggaatgggtggcattggaggcttctgagcagagaacacaaggggtccagggcagaaagcggttaggaagctgatatggtttggctgtgtccctacccaaatctcatcttgaattgtagttcccataatacccctatgttgtaggaggggccctgtggaaggtaattgaatcatgggggcagttacccccatgctgctgttctcgtgatagtgagttctcacgaaatctgatggttttataaggggcttttccctcttatgctcaacacttctccttcctgccaccatgtgaagtaggatgtgtttgcttccccttctgccatgactgtaagtttcctgaggcttctccagccctgtggaattgagtcaattaaacctctttcctttataaattacccagtctcgggtatgtctttattagcagagtgagaacggactaatacggaagctattgtgaatgattcctgaaagaccaaccatttctccagatagtctggcttgatctgaggatgaaatgtagactgacttttttaacctatggagaacttcattggctcatttgcattagtgaaactcagtgccataaaaatgcccagtatgaggcagtcaaataagcaaaggccacccttgttcagcccacaggggtcttgctcctgcatcaccctgggtcccttttgcaaggagatatttccctctggtctccatgttgggaaaaataaatgattctcctgcaagccagtttgtttttctctcatatgtatacactattgatcttatcctgtctgcctgcttgcttttgttaagaaggtgctcagagctagatctgcagtttgtgtctagcaagagtataggaccttgtggcctctgcattcatttctttcctgcccttactttcatgcaccttaattaaaagaaaagcttttattctactatatttgtgtaactcactcaaatgtggcaagctgccaatcagcaatggatatacgatacaaacaccatcgtttaaagataaaaagaagaaatccagtttgaagttcaggttgtttgtattctatttttagttccataaataaaagcatatctatgcacacacagaatgttcaggattaaacactaaatggctaatacattgctagcatgtatttctacaggagtgcctcttatctatggttttgcttcctgaggtttcagttatccccaggcaaccgtagtctgaaaatattaaataggaaattctagaaataaacaattcataaggtttaagttgcatgctgtcctgcttggttccatctgggacaagaatcctccctttgtccagcacatccgtgccatctgcactccctggccattagtctctcagggcacttcagtgggcagaccgatgtcttgctgtaacccatgttacctgtgttcaactaacccttattttacttaataacggccccaaagcgcaagtatagtgatgctggtacctattgtcataattgttctattttattattgccattgttaatcccttcctgtgctaatttataagttaaattttaccgtaggtgtgtgtatataatgcatataggatttggcactatctgaggtttcaggcatccactgggaggtcttggaatgtatccctcaaggaacatggaagagtgttgttatctttcatagtttcagtgctaactgccagtcgccttctactccacgtttctacatttgtcgttttagctcagcaatatgcgacagtgatactggtatgagataacagtctaggttgggctggaaggttaggaccagcagtagagtctgttataaatttaatttccagcccttgccccctcccattctgatttagcaagtcttgtgaacctctttggaaactttatgcacacactgagcaaacaatgtattttttgagaccttagaatttgaaattttttttgttacttttattcttgaacaaccacttgactgggtataaaaatcttgggtcaaattctgtttgtctaaaaattctgaaaattgcccaattgctgtttaacactttttttttttttttgggggggtgtttttgagacggagtctcgttctgtcgcccaggctggagtgcagtgggcgcgatctcggctcactgcaagctccgcctcccgggtacacgccattctcctgcctcagcctcccgcgtagctgggactacaggcgcccgccaccacgcccggctaatttttttgtgttttttagtagagacggggtttcactgtgttagccaggatggtctcgatctcctgacctcgtgatcctcccgcctcggcctcccaaagtgctgggattacaggcatgagccaccgtgcccggccaacactttttgttaaatataatgatcttagttacattaacggtaaataaccccatcaacactggtggtttatttttattgcttgattttaatacttgaaatgtgaaaatgaaaagccagatgcttcttggcattggtctctaagaactgatccttcattttaccttttagtctccagtcattttttcatatctcaaaagttcttttctgttatgtcctggcctttgcttatgatcaatgtgatgttttgacttccctttggccaacacattttatccatgggttggatctctgtgatttctactgtgtttctattttctgaagtttcatcttttttttttctccctttctcatattttctctgctttctgaggtgacttcttagttttgtactctgcgccgtggtcggttttcagcggtgctaagtcagcctttcatcagctcagttacaactgtgcttttggccgtgagcctttttatttcatcaacatcccgtctcatctctgcaattatttaataaaagttatataagtattatttagcatagaaggagaatgttttcaaaaaaagtcttctgttcatgatggttaatccttttcagatgagaaattatttttttgagccaatccttttctccctctttccttgtacagattttcccccaccccatgaactttaagttaattttcccttattacctaaacagctccacgttgcgtgcagttagtgtactcctcattcaagtagaaggtagtaaggattccttcccaccactgtgccctaggctgccctttactggctcacgggcgtgggagaacaaagccccacccacgggcgtggagttgtctgtcaactcagtgcactggagggcttcgcactgcctttggcacgtggcggtgcttaataaaatgcttctagaaagtctgcaaaagaaaatccccttgggagtgggtgtgacattcaatgtgtctcaaagcggtgacaaaccagcattttgtaagtaattcccttgcatgatagccaaattattatagcccaggactgactgaatgttttgaccatgaatttcacctgaacagaaatataattcactcttagctattaaaacataataatttgcatttttaaaatgtccttgatgtgttttccttctccatctctcttctgccacctaaacactgatgcttctttttcattcaagagaggttgttgatttagaaaggacaaaccatttatcttaacacttaataaaaggggaactatataaattttgaatcctgaagttgtggggtgtgatatctcactgatcttttttttttttttattgggaggaaaatatagaagtttgtagaaaacagataacactgtgggctgtactcttcattttatcagggctgaagataaagataaaaaataaaatccatcaaagacataaggttatccgatttattctcaatctgctcttagcacaagggttaccctgagctatcacaattcctaggatttttcagagacaaaatcctgccagataactaggtaacttagaaacagtgctttcaatcagagatcaccaaatgaaaagtctcattaacctggcttctccccatgagcccttcctctaaagaggttccaaacaggccacctttataaagagaaagtccatttcccagtcgagattaaaccagtcaagaatcagaatgaaggaatatgtctgaggtaccagctggtttatcttctgcaagaacttcccatcccttcgacccttgggaactgtaaatcaaatggcagactgtgaacattaaaatcacacattgaaaataatgcatctctatttcattcttttttccaggtttgagatttttaagagctctgagactgatacagttttcagaaattttgcagtttctgaatattcttaaaacaaggtaagatgttcttcgtcatatttttttcattccagtcccctatgccaagttgcaaatatcaggtgtgcttgctttcatcacaatgacattattaatagttatattattcacagaaagagtgatctaacacagagagggagagaaaaccagagtagggtttgagttgctctcttctgcagggccagggaactatgtggtgaaaagagagaaatagctgtgcatgcagggaagtagggacacttttagggacacatagctgatatctgtgtgcccagtggggttgcccagataagagccacggtgtcaaggggaaaggtgcacagtgaatgagggatagatttgctcattgattgggaagtccttgctgccagattctaaatcgcccctttattacatcactaaataagaaattgaacccagtcgtaaaggcaatagaagcaatgctgtgagaggcaatcacaaacctcatacggcaaacagaaaatcatttcatttcaaagcacattttagatgttcactttatatccgtatagcccttggggctttctctgtgaattgccttttgggggaaaacctacaaacctcctgccgaatgcaccatgaatacttctgttaactgcgttatgatctggaaaacacaactggaccaggaggaaaagcccccagaggatccctttcctgatgacctgccggcttgcagagctggcctgaaaccaaggctgtcttgatgaataaactaataaaagaggttagacgtgctctaatggagaataagtacaggccataaatttctcttctaggaaattacactctaagaagctaacttctaatgttccatttcctctttggttgcccttcatgcatttgataaatgattaaaaacaggacacctccatattttgtgatttgtaattaatatatctgtagttttgaggattagattcagcatcattttcctggtaacacaggctgggacctagcttcctgaatgaacctgacacagccaacaaattcaacctatgattggctttactccttgggtgttagtgttttttttgcttgtttattttattttgctttaattccaaattggtttcctctctctgactgctcatctatgtgactgtgaggtcaaattcactttctattagtcaagttgaaaagaaaaagagaatccaatggcactgaagtctttaaaagtatgtcctcctgccttttactgttcattatcctgagataagaatttatcagtcctctatttattagcaataatgtaatattattcacatacagtgaatattgtatttcttcatgtttttctgattgccaataaccttgatttctgccttttaattattcttctatgtgctagaatcatattacttttgaaatgtaaacgatcaatgaagctagcatctcgccaatatttacgtatgtcagattcactccactagactgtgttttaaagatggaacgcgtgagtacccagcaccaagcatagagccttgtccttaagagacacttacttttttggtagggatggtgttttgtgacactctctaacattgggtagtgtctgtctctccctgtttcacaattacatcatatgttagggggatttttattctctgatgccagcattttgagaaggttccattgctctgaggaatactgtctactccctggaccgttttagaacttgagaaaatgatggaccatctgaatatctttttctgactttctgctaggacactcacctctctttcctttggatgcgggaagtggctgtgggatccctggtgtcagctcacctgccaactgcactcagtgctgcctctctcagtgcagagcggggaagctgaagcagccagccaggggacgagggagagaatggccctagggaagagtcacggggtggaaggctgtctgggcatctgccatccgggccccaaaacagcctttttccagcaccccacttcccactatatgaaactcttgttgttagagggtgctttttgccacaaacccacaacctgggttttcagagttcctttcacttatggtcataaccagatggttgagataattcagcaagcctggagtgagcacccattggtatcagcagcaaggtgcatgctaggagtcctgctgtcagagaacttgctgcgtagggggccaggccacctgacggtgtggttaatgctgatgtcagcatgcccaggggttgagaggggagtaactaagctgggcttagcctgagttgcagggcagtcaaggatcttttcgaggagaaggttacttttaggtaagccttgtagaaaaaagtgtcatcctcatggggctgggcatgtgaggggtagggtgggggttgacttctaatcaaggaagatgctaacagcacactggtgtgagagcataacacttggggaaactttgggtaattctgcactcctggacattaagcgttctgtgatggaaagaggaggatgaggttaagagggtaggaaaggccaggtcaccaggcacagaagcaaacgtcatgtaattgtaagaaatctagaagctttaggacaactctctgaggccattctctctccaggtgccagcctggctaatcttggctccttccttttgggcatccccaagtgtggatcccaaagttctgtcccagagaaagtgcagccttggcttttgtagggttttggacttttgagcgattctcctgtgactcttccatactctgctgctttcatagcggtccttccagaagggtgggttgggggacccatgtaatcgtctttagggagattttgtctggctctctttggcggtgaattcctgccaatctgtggcattaggcagggatggaggctttgcaatgcaatttgaaataatgatttggagttgctgtttcatttccagtactttggctgcctcactgggccaagagctgaaagaaataaggcagagaagcataaggtgggcagaaagattgataaagaattaagaatgcagcagaaggaaaattaaagtgcatgggatgaaatgggcaaatcacaattatgtgaccagcatcagggccctttcccaaactgcaagcccatagggggcctagaatactccatagcctgaaacggccaattaaaggggagacaaggagactccctctcactatctgaggttttggcagtttctcagttgccctgcaaactggagatctaacacacaggtgctagaacacttattctactgtcagaggaaagtcagcagctgtgtttaaaggctgtaattccacatctcattgactgtggtaaatattgatgactaaaacatggatcactcagcaattttttccaaaatgggaatttccttattgtttcctctaatttttcttttcttttcttttcttttttttttttttttttttttttttgagatagactcttgctctgttgtccaggctgggcgtgatctcagctcactgcaacctccgtctccagggttcaagccattctcctgcctcagcctcccgagtagctgggattacaggtgcctgccaccacacctggctactttttgtatttttagtagagacagggtttcaccgtgttggccacgctggtctcgaacttttgacctcaggtgatctgcccactttggcctcccaaagtgctgggattacaggtgtgagccactgtgcccagcctgtttcctctaattttgaaaatatgttcatggtaaacattgcaacaacacacaaaatcacataggataaagtaaaattgcctccacatcacactactttgagataatgattacatctactatgtcaccttttgtttctcacatagcattccatgatatgcatgagtcatcgtgtacctaaccaatatggttttgggaggcgtttttgaaactaaaacattactactgacatgaacttagaaatggctccaagataaagtttgtaaagaagagtattctatatggagactgcaagagatgtgcagggagaggccaaatcatgcaggttcttagattcatggactttactgagaacaaatgagagctgttgaaggattttaatcaggagaggaaatgtggttagactgacattttagaaagatccactattccaacagttgtatagagaatggggttgaagcatcaaagacctcatagaccataagaccaattaggaggcagtagtccagggaagaggtattagggcatggccttaggcagtgcaaattggggcagagaaagaagaagggatctagagataattaagggattgaattggcagaatttcactttgttccactcatgttgtcattcagaccatttatgttagtgtggtgcagtccagttaactttttagggggtgggtattttacatctgtccagcaaagagagcagtaaaacaaacaaggccagcagcacctggcagtaccagaaacaaagagaaaaattagagacaagcagaacagggacaaacgtacacttctttgtacaaagtgcatggcattttctgtgttaactgaaacatgtcttgttaaacatatagaggacaaaggaggccccagaagctctgggtttacagctgtaatctctggagccagaccttctcttgcagcatccacagtttcttggaagaggtctctaatctacaagaatcctgtgcctgacctatcatgattcactgtgtccatcgatgtgaattagaactcatgggatggagactcaggaattgtataggcaacatgagaatgattgactttagttggatcaggtgttgatgataagatcataatctccctcaaagcttaggaagcaggctagaatctgaatggttcaaatcattctaaccgctggtagcttcgtgtttggcccagatccctgggcttgaccaggaaggctatgactatctccacacagagatatataacctttgctatgcagagcacacagccctgctcctggcgtgccccactctttcttcccaaggagccctacttaacctggcaaggttcacatttcagactgtggagaatgcccaccaggggttaaccttgcatcttttgcttgtagctttcagatgtgtggtcatacagtttcatttagaaagcaaattcctaaacctagggatctgtgataatactgatgtcataaaaataatcagatttcagagctaaacatggactgttttagcaacaatgattaaatgttctgcatatggcaagagctccctaacgcactactaatatcactgtaaccatcatttagagtttagtaatcaccatatttaggtcatttttccaaagcaccaaggagactcagactctaaataggtttaatatctcaagaggactctacatggttgttggtgggacactgctgtgttcaggtcccaagaatccaggagtatgtaagtgaagccacttggtatttaacgataccctgagaaaatgaacaacacacacctccctaagaggcctccctttgtcgccggctatcagttcttcatctatttcttaccctccaatgtgggagcacaccttagaggacttacaaggtacaggcaggagagaattctgcttaacacaacatctaacacataataagggctcaataaatattggcaattattataatctggtaactctagaaatgaccaagagagacagaatggacattttggctgtttttccaagttttcgagccagaagaaagttgttccacacattttgaaatatcagtctcacccacaaagttgaatctgtttattctttccatgaactgtcagaatcaactctggaaaaactaagactatggattcctctgtgctcttccatagaagaagaaagattgttgttatgagcattaaatgacttagtatacataaagcacaggtgatcctaaagcacttaggatggtggcacatgtggtgagcactgggaaagaactgtaaacaagctagctgaaactattactgtgatcttaaatgcctagaatttaaatcattggttctccaaaagagaggtaagagagggcagtcataacagagatgaactgaccaaaactaatgggttgggcaaccctgtaggctgcattaagccactactgggaaaatgcaagagctagaaaagagagttcttttctgcaagatgcagcaaggaacacaagagtcaaatagcaacctaaaactttacaaaagacatcttaagtcagtaggatcaattaccaatgaatggctggagttgagagccggggaaagtcactttgtcttgcagatggatggaacgactttaaggaagcagtagggattgaactgggctttgaagaatggggaaatttgactagatgggaagggctttcaagttgagtaaatagtgtaaacaatagctatagtaaataggtttagctggcatggcagtttcaagagtttatgtgaaagaggggtggtgggagagactgggacttcacaaggtgttgacaatggaaggagagagtttgaatgtcatcttttagtcaacaagaagcctttggacagtgaagtgacctgctgacagcagcgttcaggtataccccagtgggactgaacaggatgcagtttagaaagagagcaggggcagataccagtgcactcagtgcagagtcacgggtctgctatgctccagggacccagggctcctggaatccagacagacaaggcctcagctcttagggacctcaaaatgtcataaggtccagttgatccactcaaggaacaccagtgaatgctaaagctattaggtataaggtttttggggagcaggatattcctgcagtctcggggcctcactcaaggtggcatattcattacaaagggaaatgggcacctctcagtggagacattagcatttctgccttagccacatggatggagctagtcattgggctgggatatcctgatgtgatgccatccccgaagagattcttaacagaaatacttaagtagggagctatgtaggatgatcaagtctagaggtctaatgtacaacatgaggactattgctaataaaattgtatggtatttgggatttttgttaaatatgtagattttagctgctcttgtcacacacaaaaacgtaactatgtgagatggtaggtaatatcatgttgtaaacctcaaacatacacaataacatttatttaaaaaataaactgggctgggcgcggtggatcacacctgtaatcctagcactttgggaggccaaggcgggcagatcacctgaggtcaagagttcgagatcagcctggccaacatggtgaaactccatctctactaaaaatacaaaaattagctgggcgtggtggcgggtgcctgtaatcccagctactcgggaggctaaggcaggagaattgcttgaacctggcaggcagaggttgcagtgagccaagaccgtgccactgcactccagcctgggtgacagagtcagacctcgtctcaaaaaataaaaaataaaataaaaataaataagtaaataaacaggatccagaatatagaacattatagaagacaacctaggttcacacaaaatttaatgtcattacaaaggagtggtgtcaattatacattagaagggactgaagctgggattggcaaactatagcccatgccggctgcctgtttttgtaaataaagttttattggaacaaagccatatctattcctgtacatgatgtccaaaagctgctctgaagccacagtgacagagttgagtatttgtgacaatgtctatatggcctgtaaagcctaaaatatttactctctgtccttgtttcctgacagttggatttaagccacctaacagccaaatgcagtgcatgaaacttgggtctggggggaaaataaaaaaaaatcaataaacataattttggggcaactggagatatttaaataaggtctgcatattaaatagcattactgaatttttatgttttaattttctgaggcgtgcaatggtattgtgattatgctgtgcaatgcccttcttcttaggagttgggtgctaaagtatttagggcttgtgccatgatgtctctgatttattggtaaatggtttagcaaatatatatatatatatatgtacatggcaagaagaagagaagaaaaaagggcgggggggataagagaaaaagcatgtagggagataaagcacccgtggtaaaatgttaataattggtcagtctaaatgaagagcgtacaagtgttcattatactgttctttccacttttctgtagatttgaagagttttttaaataaaagttaatttttaccaaagttaaatttgttcctctaggctctgtcctgaccttcatcccagcagcttcctccaccttccagaattcccttataatggagaaatggttgggagttagatgtggcagcctctcctgctaagcgggtgctgttaccctgtaaggcagccccagcagggccttcccttggtaacgtggggattttgcttgttgtctcttgcacagtaattccatcaagctggtgaatctgctctccatatttatcagcacgtggctgactgcagccgggttcatccatttggtgagtaaccttgaagacccttctgctctcgcttgcctgcaacaagaccctctctgagtcattttattacctaaaatttatcttgctggaaattaacttcacctcggttgtagacaggaagatgggaagcaaccacacaattgtctgggtttccaacctttttaccccaaactagttccaaatggtgagtaatgtttgcactattaacctgcatttttcagttcattgctcattggtattgtcatgggggctttggtagattttccttctgtctgcaataactatagtaagccacaagatggcagtgcttcctaagcaaacacctggaaaaggtctggggacaaggttggaagttggacccacacctcctagtaaacaacaaattcagatccctcaatttctttccacttccgccttacgaaaagccacctttgattattttgtctgatttgtacctcaaaaatgttcattctttttcattagtgactctttgaaagccttgtattaagtcaagcccctcacaccacccgaaggcagactttccccctgcttttagagagcacagccattgtgggaagtgtgtttcatgcaaacatagactgttacaactggaaggagcctcgtctagctctgagactttggataaagttgaccaccagtggctgagcctctatttgcataagggatagaaggacgcgcttagctacccacacttgggatttaggtaattatcacccaaaggaagacaggcctgggatggcagtggttggggcatggggcctcacgtagtcaccagatctagagtctcctgcccagcccttaatgctgatgggattcatggccaaaatcaaccttaatcaccctaattcttgctgtaaccaagcacgaagcacccaaatcacatatgtggaggagatagttgtctttaataagatgatgaccccaccttactacgggtattagtgaagtcccttcaggttcaccaggaaacttttgtgaaaatggcacattgaggacaaactgatgtgtgaaagaggccaggccctggaaacattttgcagaggcagaggtggaggcctgggggccaccgtctacaggccctgtgggtggatcacaggcatatttgagtaaaattgggcccgcagctccctctctcctgagagtatctaaagtacctttcctgcccacctactagccttgttggcagatcaaatatgatggaaggacaggaaagtggggaaactgcagtctcgggccaaagctctccaaatccagccacacccatttgttgaagttttgcctctgcagagttgaacaggacctgtgtcgcccacaaaactgaaaaagtttgccagcccttgatctaacgggctgtgccagtgcaagctgttctcatgagctcactttccatgcccctgtgaagattccagcagcctcaaggctgggaccaccattgccaatttgcaaaggagggagagcagggccagattccagagatgctgtttgaatcagaaataagcagggcccatatatactctttggataaactgatggaaggaggcagccccctacggaagtgtttagaatttctgtgggagaggcagatccaggccatctgggccttagaaacccattgaggaaggtcagggacggaatctctggctctttccttgaagagagtgctctaaaacctggccagaggcaatgccctgaattttagctggcttcccacattttaccagaagaagagaaaaggcctagagatatttcccttcttgctttccctctctgtctcaatcagccaggaagacatctcctgcagctgcttctccactttctctgtgtcctgctcaggagctctgcatcctgactcacagaactcagcccgggaaccacacatctcgtgtggagagtggtgtgcagtagcaagtggccttcgagagtgccgagcttccgcgtttattgcatgtatacacttcaatagcatgtttttcttttttctcccctgtcccatttgctttaggtggagaattcaggggacccatgggaaaatttccaaaacaaccaggctctcacctactgggaatgtgtctatttactcatggtcacaatgtccaccgttggttatggggatgtttatgcaaaaaccacacttgggcgcctcttcatggtcttcttcatcctcgggggactggtaaaaaaaaatctttattatgatgttgattttgatggctgttaatattttccatgatacatttccttaaagctttgtattttagactgtattctgcactagaagcaagccttaacgttacaatcaggctaagtaaatccaaacacgatggtgacttttctgcataattcttggtgtattacacttgtcccatagatccaggcacattgcccttgtcggggacagccatttagccaggagcaaacctaattgtcttaagaaaagtgatgctgttaataagggagagtgtctaccccttagcaatgtaactcagcatctggtatgctacaaggacagtggctgtcacctgcctctggtagaagctgtcgatactttgtagagacagtttgcggtttcaagagctctcccttcccctttatgttcctcccctaacttccaacaaacactgtggctggggcctgccctaaagagaagggtccctacatcaaaggagagagagcaccttagtcttgtccaggcggacatccccatgtgagcagagtgcagttttgcaaacagctcactccattctgcagcggacacatggggtatttttgctcctttcttctaagaaagtttcactgtttgctttttaaaagtctacgcagctctttatgttgcactaaaccaccccttctaatgtaaatcgaggggatttctggccacacgttggcagttgctgcattttgtctttcaaagtagctcattttaagtttagattttttttgccatttatgaagcgagtgattaaaatcctaatccatacacagctttcatgtatgtacaccgtgcgcacatttatatgtagtgatgcatacacctctctctgttttgtatgcatagggcctatacattttaaaaatgtatataaatgtgcacatgcatgtgtacattcacgcaagcatttctacagcatccgtgaggtgcctatagataaaaagacccatccagccagccacaggccagatgtttgttggacaaaacatggcagatttgtgtttctccttgctatcttctcctcccaggtgatttcctaaatttcccttttgagcttttcagtgtttttttttttttaatagaaaaatgtagtttttaatcttttggtgtttattttcttttgtcactcataaaagcattgattctcctctgaattttaatgacaaaggaagatcttctcttgcgaaactgtgtgtgtctgtgcatgcacacatgtgtctgtgtgtgtttagtttcactagcatgtccccctcttgcctatttttcttcagcaagaagaactagatatcaccttatttattcctgtctcctttgtatttttctcgactgtgatttttttttgttctttagttgtcaaggtggccaatgtttgtttgtcttgtgtatttctgggagcttgctctcttcgtgcttttagttttttatgatccaacatatcaatatatacctttgcaggcctaatccttttgtgttttcagatcttagtgcccccaccctctgaacaggtccccccttttctttggcctgtctttttagtctctcttctgtctcctatcttctcaggccatgtttgccagctacgtccctgaaatcatagagttaataggaaaccgcaagaaatacgggggctcctatagtgcggttagtggaagaaagtaagtatgccaagaggttttgctgcctctgctgcggtagaatcctctctgcatgccatttttttttttttggctcttgtttctttgtttcatgcatgtaggcaatgtttgcccgctacgtgcccgaaattgctgctctcatcctgagtcggaataaattcggcgggacttttaacaaacatggaggcagaaagtaagtcagttgcatcagaaaagatgtggttgagtgactttcaggagtccctgtggaggtgccatctgaattctgcccctccccaaccccaccaggtgcttctgtgagggaaggcccagtttctgcatggggtgtgatgtcagaggtgacccgaggacgttgccacgcttggaccaactcccattcacaaattccaagagatgtaatgaatttatcctgaaaggagtccatttataactgggcccatattttctcttctgacccctaacaagtaaacaaaactcgttcattcttccatcatctggctatgtgataaaattctggtccctcaaactagtatgatgccctcctatggtggtttgtgtgtagcaagaacacaggataagactctggcagagaagtccttgggtggcagatccaggtcatctggcctactgcaaaggcactgcggccactgggaacccagttctcctcttcatccaggaggcaccgatcttatcctcaaagggactcattactcagctgaaattccttccgggcaagaaatagtatatttctggtagtttagggtactacatgctattcctgccaaatcttttgtttggcttcccaaatgtgaatgctttcttctcgggaactattttagtgtgtgctcagatcactttatcactctcgatatcaatgtgcaggttcaatagagaccccaaggttttttcctaagtagagggcagtaccttacaacctcaagaggagaatgccatgggggagagggggctggcagcagccatcctttatttatttttttaaagctttttctggagtagtcacctttgtttgtttttggttttgaggtataacttacatagagttaaatgtacacatctttaacatataaagtgaggaacttgtacctatgtacacacccagtcactatcatcctaccatccggatcaggacacagaaaactttcatcactcatgcctcttcccagtcatggacgttcctatcatggaactgttttgttttgttttgttttcccttctcgttctgtttcaaatgaactcttaaagagcttcttttgtttttttaagaggaaataaaatcagactgggagcattgtatttccctccactgctgccttctctttttgacagtcagccgtgtgggacagagtggaccctcccctttggtcagtgagtccagtgcttcctgagctcaggtgtccaggcctctgcacaggaaatgaggaggtggacaaaagggctcattttcttgaactacccacaggacacccgtttcctttcaaaggcacaaaggacagtgggccagaggaggccagttggcgtcttttccgggaggcagcacatccctccatcttccctctaatggagccctcccctcaatattatcttaacagccctggatgaggttagaaccaagctgttctgatttctgggccattggttggatccaaaaggccaaataagtccaaagattcccagtggtcatgtatcccatgccaagaggaaaacagcatctcaattcattttgccttgaaggtgtggacaggtctccataaagcagaaggcattctgagggcctggggctctctttatggcctccctatcttctgacgtctccgccagcatttcccaatcactgccccaagaagtcaataaaatcaattgccctgaaggctaagttgaaaatatttcttgactttcattccaggtgattttttttttttaatgaaataattttcctagtcaaatgtgggtgagctggtgggtgggctggaggccggcagcttttggtgccagctgacccagatggggctctcagcccggcactcactcactgcccccagtccgatccggtcatctttcaccctggcagttccactcaaactttcaggtgctgatgacttcagatcacagacttcctgccactctgttctggctctgtaatcttttatcaccgcttttagcctggttttctctctctctctctctttctcttttttttcttctccgtttatgaaaatgcactttgcttttaatgttctttttgggtccccactgttcctgaccctgcagacacagagtccgtcctgtcatcagcaccgggcctgttcactactttatgcattgtttcctggttcaaaagctaattactaagtagtttaaagaaggcctttggtcacttagatctttcatcagaaaatataagcttgggaaaggcacggtaataaagggccattagcaccctttgtttgatgttgtttttccagtcagtaaaacaagattgatgaaatgttatgtttggccaaattttgagttttcatttggaattcagtgttgagagaatgggctgtcagaatcaataagttttctttcgcttgggatatgggcatgtggtagtaattagcaatataaggtctttagttgagcaaccaagcatggattctggcagcaaacataatgagaaactacagttgttctatttctaacgtcaaaaagtttccagataaaattaaatgcatttgcaaaaggaaagcagctaaactttgttgaaagataaagttcagactcttaaaacagtgtgctgtgctctgagtttttgtgtatgcataagtccatgtgctctgcccatggacacacacatacatgttctctgctccccaggacccaatcaaataaatgcccagaaagaaattagaatgtatacatagttaagggatttgtttacttgtgcatattttattcagaaatgatttctctaacaatatattaacttgtcagagaactcaaggtaactcatgatctaaagctacagagacataaaactttgaaattcaaagattatttaaagtacaaaatttaggcagagaagatcagggttttgtttgtacaacacccaaattcaggatatttgagaatatgaagatttcattggcatttcattttcagttttaatcaatgtgtttggcataatataaacatttcaagtagcattctcaaagcctcttcaccatcaacactatttcaagggcctagagtgccttacccaacattttcatcacctcctgaaggatacccagtccctgcagtaggtatgggtaattgtgcacatgtgcgtgtgtgttggctatttcatgtatgttatgatggattggagcatctaagaataggggtttgggtgtccacaaccaagggttcagtgagtagctgaggcaggtaatctctctgagttggagggattagagctctctgggctcttgggctgataccctaaatcttattcataagggagccctcctgcagcccagcctgcctcccaaggccactgcctcctcctcctttcctttgtgtaaggtcaaagctgcttagagacagggaaggcctgagggctggtgacgctcccatggcctttgggatccccagctctctcctccctctcacagccccttgcagtttcccccagaggtctcctccctgagtgtgattcattccactcctggttagtttatgagaactgacaagatcgtggtccaaggtcacatggccaagggccatggaaaataatcagtcacagagaggaatccatctgctgtaacccccttgttagagggagtccagccgggagccacccagaccttgtgtttcccatgttgggacttgagtgactcaagtttgaggcaatcctaggcccaggtgtttgggacagagagaatgggatgggtttggattattctactgattcctggtagccaaatgctgacagggcacacgagaggggaatgagtcatgaaagactagatgtagccaaggtgggagaggaaagtgagtgtaattaacttgaaggaaggtcctcaggatgaagctgctgagccgccattctggtttggggaatagttgtcatggactaacccgtctcttgctccaattcaagaaagctgcctgtgaaacttaaatgctgtggcttctcttggaacatttgcctatagagacaggagtgccacacacttcctgaaatgagaatgtgaatcagtgcagcctaaagccccaggactgccttctctggcaatagtaatacctacaaatatttgcatatttcagaatcctcacattgatcctgtgagaaaggtattaccatcatctccatttggaatgagtgaagaaactgaggaacagggaggttaagtaacttgcctgacatcacgcagctagtaaagagttgggctggggtttgaacctggacagcctgcttccctgcgtcctgctgcctctccatgtcatctcttgagactccattctgctctaaactcagtgatctcctattgtttgtatcttcctccacctttccgtataaggggagccagagtaccgtgctcatgatggagaggaagagaaaggcatgagcttcactttggggctgtctcctctcccctcctgcccacccactacccctaagggtcctggccccaggattgaggggaaaaagatggagaggggacaaaaccattccttcctttatttttcccatttggttagactagaattctaattccctcttgaacacttctagcaatgaaaggctctcaaggacagacagatgaaccacacctaaagtgagaattgtgccttttttgtggatttcaacattttcttccccttcctggctccatcctttaaaggtagttccatggagaattgtagtgatctgctaaacttggacttccctgctgggcagatctcacctgcagagccttctatacccttgcagatggaaccacctgttccctttcactccttagttagtctgccgcacagcacagagcagtatctggaggtggtttcttccttatcagtgaaaggcacagtagagccccacgtgaccagttctgcagggtgcattctgtgtgtttgtttcatagctttgacttggaatattcaccctcaggagcctgtatcccgctggagggagttagggctgtctgccttcaacctcggatgtggtctccacattggaaagagccttacattcagagagatggggacagtttgtcatgcttttctatttaaatatgaaactagagtacttaattatcttctttattgtaaatgctcatattttaaagaggattccatactttagaagaaataattgagtattcaatagttgagaacaaaattcaagaactaaaaacagcccagcacagttagtgacctgcctcactgtccattcctgtggcccctctccatcggttcattcactcactcggcaggcaggcattctctgtgttatgcatcaggcatgatgctgggttttgttgggtgctcagggttcattggcgaacaaactaccctcggaacctgtcctcctggagtttacagtctcaaggaggttgcaagcactgagcaagggtacaactaaagcaaatgccaattacacatttttaatgtgtgctgcaaaaccagaaaagactaagattctgcaactgagaaaaacagggattagttacactggataaagtagtccaaggaagcgacacctcagaggaggagatgctaactaacgcttgttcaatgaccttgacccagcttgcattacccactaagctgggggagctaacactcttgcttttaaaatccaggttatgcaagccccacttgcaaacataggtcttcagttctacctccactagaggaagtcttaaaaactgattgctcgctcagaccccaacctgcctgagcagtgcttgcttgacttatcgggagatggcatcctgcgtatcttccctgcttcctgattattgggttatttttaaactctgtgtctttccttatatcagaatttggactctccttctcactcagaacctttgttccttcctgagagcgcacactattccctcctgcctggctgtcttgtatcaacgtggaattccactccatttcctccaccacactcatgtcttgtccaccagggttctagactgatttctaaaggatttggaattttaaattgtctagtgtgccagagcatggatcatttatttacaaagactcatttaatctatggccccatagcctaccctaccttaaaggaattaacatgagtcacgccttcatgtccatccattccacatgtgtttactgagggcttgctaccaggcactggggacagatgcatttctacacatccataaaaatctccaactataccacagcttttctgagctacacatcgtactatttggccacctaagtggttgggaagtccaatatcagggcttattgaaacctcttctcttggttctgagagagtcttgctacaacaccatttccctctcgactctttctgggaaggcatggcctctagcacttgggaatcggatttgagatgatttcatgttatactgacttgggccgatccacaggccttttctttccatgtttacttgtgtcttgggcaacagctattctcacttttcctcgcctgcaaggggcggactgctctcatgaggggtgtttcctataaaatgtcatttacgatttctctattgcagacatggctctggtcgaaatgtgactgaagctttgcatcctacacagacttagatccctcatcaagtagccattcagccctcattgcatgagccacgtgacttccccagcctgaacccctcagcaatgtctttggattcctagattttaaaagccataaattagcaaatcatcaacatatcaccaggaaggatcatctggtagcgattctagtcagaaggaaacacaggccccaataaccgatctttacaaagatatgaagaactgtagacagacagatacagtaaataagaagacaaatagataattcaagttgacagaacatcttggactgattaggcattctgctttgattagcattaaacttcttgggaacagggaaaacaaaaaatgagcttgccctaatactttggaaaaatgacctcttgactacttctgaaacgtggtgctgaggggtagatacccaaagcgcttgtcattagatgccatgtcttctgatgtgatgtgctaggtatcccttcctgatgagaggggtcttggcgggcgtgggacatgggcacttctttcttggcatctgttttggattcctctaagccatatcttcagtccctttcaaacttgaagctctatttaaagagacttggaagcatattaaatcaatttcctgataatactgatagaatgaagctcccctcctttcctgctgtcactcttcccttccacacacttagcaaaatgttccagctattgttctgaaaacaagaatagaaatgtaggtgggagatgaactgtgtaccttaaaaaaaaagtcgtattcaagcctagattttcactctcaaatattctttcttccattaaaaaataattcgaatatgatttctcaaattataattgctgaagattctgatcaatggctcctttgattgggtgaatccttgccgggtagattcagaatctcaggaacaattgcagccatccagactaggttgccccctgttttctgtcttcgtaccatgtcattcactctgctggacttctttccagagctgtgcaaaatggttcctggtagctttggggttccttccatgctgctgtcatcatactatgaaactaaaccaggaaactttctaactggccaagtccagtgtctctttttattaaaacattatagaggtcaatacattgtgagagttgtggaaatctgattctcttgtcccaagggttccagtctccacagccagtactggtgttgcatcacaatggcctgctgtcacccccagaaccacagggactgttccaaatatgggtaccagttgctggaaaagtaatctatctcccctccttgtacctttctaacaagaggacatgggggcagttcagagatagatatgtgcccatctcagtgggagcttatatgaccttagccattgactccaaaggcaaatgtcagctagtgtatagaacagccttaggaaaactcccattctaacatattggctcaacaaacaataatttgaatccccaccatgtgctgtgggtaaaatgtggttcttgctctcctggagcttatctgagattctgaccaatcagtaccacccaaggaaacagtggcagtgaaacagaagcttgagtatgcaggagcgtcttcccagtgaaatgctcttttttcaggaattttattcattgaaatcatggaagtgtacaataatcatgaaagcaagagacattagagggaagcctcccaaaagcatttgataattcacgttgttgaacatacccattgaacagtggagagcataggtaatagcagattgccttgttcacctaaaagcttacagacccagtaaaagaggggtgcagaaagatttgggagggttgggaatccgctgatgtgatcctgaggtccactcctttccagaccccacaaaggtcctgctgtggcctgtcatgcctcgtatcatgccttctttttacttttttccttttctttttttttttttttgagatggagttttgctcttgttgcccaggctggagtgcaatggcgcaatcttggctcaccacaacctccacctcccagattcaagcaattctcctgcctcagcccctcgagtagctgggattacaggcgtacgccaccatgcccagctaattttgtatttttagtagagacggggtttctctatgttggtcaggctggtctcgaactcctgaccgcaggtgatccgccagccttctaacctgtagctccttccagtccctgtgtgactaacagatgctggaggtctgctggggcctatgcaagtatgttgagtctacagagtgaatggctagcagcttatgctagctgtggcaacaccgttgggtgtggctggagaacaaggcaaagatatgtcaagttggttgtcattatgggagggtcagtcccaacagtatgtgctcaaggaccatgatacatgattcaccaggggtgttagggagggaggtggggctcgctttgtaaatcaaaaccctctcctgggcaaaattcagagccatttctttgcttggactcattctccctctattccaccttcatccctgaagagtgaggctgacctttgcctgccttagtcttctctcagtctctgcttgtacagaagcagcattaaaaatgaaatcgggcaaatctgctttgatctgaaaaaaggaaagtgccattcagctccctgatttctctgtaagagcagagaaccatctagcattgggagattcaggtcaagggaagacttgcttattttaaaatggccaaaggccaccaagcccaaagtaatgggatgaataagatgcagaggggtgagggtgttggggagggaggcataggaggaatcagtgcagtttgtgagggttcagcaactgtggaattgcttactgaagaaagctgcagaattccccttccagagaggaaggaaggaaagaaaggaaaggagagagaaagaaacctaaatggtggtaatacttgcatactaggtaacagtgagaattaggtgagaaaccaaagtaaaggtaaacaagtctaccagttaggattctctggttgcaggcaacagaaacttatttttttgctgacttaagaagaaaagttttttgttttttttttttaaaggttagggtaccttagagattccaatgaaaaactgaagagcaagatcccagaaaggacagaaaagaaccagagatgcagctctgacactgaggaagtggaaactcgggagtagtcattacagggttttgtcatcaggttgaatcaactcccactgtgattagcatcagcccatccaagatttaagagtacccattggcctcacttgggcagaaaaccttcactaaaggtcccaagactgtatataattgggagactgtatttaatttggggaggagcaattccccaaattaaaatgaggtgctgtccacagaagagagggtgtatgcaggacaggcaaaatctaccaatgtccccggcactgagtttctcagaatttaaagacttggactgaggctccatgtaggctacaagctacaaaatatgtgtgatcatttctcaccacggtctaattatggaggtctaactgtgatttgggatggtggaggtgtagacacagatccctctagggtagctgaggttctgactgtctgcatgcgataagatgcaaagttttggcccaggtgggacatcccggtattccccactggggctgccagttgtctgtcctctgaccttggggctctgctttagaggtgcctttgctgcactgttgggatctatttgctcagacttctgccccatttagggaaacagcagcacagcctgccacatccagaacagctccattgacagctggagaagaagattactttattcacttcctcactaggagggagaatgcatttccttcctttgtgattagcaaagtactagatgtgtccatggataggaaattatcttattgctgaacctccttttttttaaaaaaattattttaacaggaaatggtgatagtcagggtttggggttgtgggactgatacacactctcatttgctttgtttttatttttctttatgtgtacagatcccttacaaacttgaaatatgctagtagattcagggtggtggaataagcctatggtctaaaaggcttgcagtgaactacctgttaacttttttctgcacttaccatgggatagagtctccaagatgcatactttgtcaaccaatccatcagttaacaaatagttcctgaaagcccagcaagttttgggggttccaagccaggtcctggggtagggtggagggatgaggcagcacagcctggagttaggcttcatttgcccatgatgtctcccctatctttactgaagtcagtctctttgagacattgagtaaaggaggaagtgggaaggtgggagttggattagtcttattttttggcagtgggggattgagcctcaagggaagcgctgggaaacagtaaccctgaaggacatgccccaaatcagggaaacctgcattaagactaagtagccaagaaaagcactaccaggtgagaaggaaaggaaaggccagcttgcaggagtgtcatggagaggtggtgatgcagacaccaagggttcaaggtcaacctaggggggcaaacgtgaagctttggtgctgaccactgtgtggtttaggtcgttgggtctctaaccccccacgccctgcttcctgtatgatacagtgctgctggttctcttgagaagtacttcttaaaattcattcccatcatgtcaggggctaccaatggtgagatgcattttgggaggagcaggacgaggaaaacacaattagaaggctcagcagaaagacagagagtctagcatatgtatttgatataaatattatagttttacagagacatctagatcaatatgtgccacatttcatctacctctttgacaaagtgagcacaatgtattcaggcaaagctgtataggattttcaatttactctgtctgatttattgtgacaagatagctctgggttttttaagttctttatactcgttccagtaaaaatggatatagtatctttaaaaataaacagcccagagctgtgcattttacattgtcttcctagagcgaggctctgctaaagaaagatctaaggcctccccgccctcgcagaacctgatcgcagtaggatttgctgccatcccttctctttggcttttttgagggagtgtgggaatggttgggggcagtggggacagtaaatagggaaatcagttaggaagcgattgcagatgtctagataaggtatgatggaggtgtgaactaaggtcggacagagaactggagccctgtgtgaggattcatcagtgtctggtgggtgcagcccagtcagcctgggcctcttcattttagtgactggccccaggtcactgagaactcgccccccagtctcccaattcccagcttaggttatcctccctggcaccagctgctttctttcatcagaaggcatgaaactgagggaggtgttgtgctctggatctggcactcatcttgcaacctgtttccacatcaaagagaagaaaggtgctagattaaacaattgccaagggctattcattcagatgctgagataaacttaagaacgtgggagggggcccaatggtgactattccatggtcacagtttcccttttcaaaggctactggctctaacaaccagtatctgaggcttgggaaaagtatgtagattttccttgtcatagacctaaaagtcatcttcagtggctctcttgatgcctcagtcactgccctcctgtcctcttctgccttctgccttaagtcacttcccctaggttgtcctgtgtacctgtggaattgagctctgaaactgaagttctggctcaacttgggcatgcaggctttcctggcccatcactgagaagagagtagaaggattgagaagaatttgtgggatttcattctggaggcagcgatgcttaaatggcaggagaagcacacccatgtatatttagtgaagatatgcacatgaaataagcaactggcgaatttatggtgaccctcaatagtgttcataatcatcaaacttcttctcatgaagtcattcttacccctccaatgccgtgacccaccgcactgcccttttcagttaaaccagcccatatttatggagccctgacccagcaccaggcactacttgctcacactggatgaataattcctctccagaaagtgccgttggatactattttggcattgaagatgcttccttgtgtttctgaggtggatcttttattctaagccatgacctgtcagcttatatctattttatgttacctttgcccaagaaatatttgtttacagatccagacctagcatttaaaaccaaaaacttcatcagatcagaaatggttattgattgaggactattggtcatcttcacaaattgagtggtcaggccctatagaaattggtcaggacaatcgctgatggtctaagaaagttcagatccacatccacagatggggagagatttagctactctcatagctgaactttcctaaatattccccattgtaaatggatcattaagattcttattatcttctagattccaggctggtgaggaagtcctgagctgtacatgacatgtctaaaatagacatttggggtagggcgcggtggctcatgcctgtaatctcagcactttgggggccaaggtgagcagatcacttgaggttgggagttcatgaccagcctgggcaacatagcaagaacctatctctacaaaaaccaaaagaaaattagccagctgtggtggcatgcctatagtcccagctacccaggaagttaagacaggaggatcgcttcagcctgggagttcaaggctgcaattacctctgattgagccactgtactccagcctgggcaacagagcaataccctgtctctaaaaaataaataaaatataatataaaataaaatggacatttgcatcactttgcagccccttagcttgctccaatcatatggcttcagttaagtttggcttagagttcctgaccggtggaacttatgatttctgcctgtaatcagactttgctaagactatcatgatactgcctatccagccagactctagtgatcttgcaaaactgtgatggtttatccactccagttcccagactaaacctctcccttggccagtggaggacccctccaacaccccctccaccatgtatccaggaggacctctgtgggtccatttctgcttgccctgaaggagcagaagctgagatatacaagcctctttcctttccaccaccaccttcatcttagtgggaactgaagtgggagacccagattgcatcctgggcaagtcacttttacttgctgtgggatgccaggcatatatgacttaaggaaagagtttcagagaggttacctgaaaagactcaggcagtgagaacacagggttgttgaaggattaggtgggattgcataggccacagaatactttatattggttacatcctaatttacagataccatatggcacttaccatttcatagtgcttaccatggagcagattacttggcccttccatgtatcatctccttagatatcaggataacttcatgaatcaggcaccagctctggcccctcaaaggctctggctttttaattgtaaaatgcaaaattggtacattgtccaagactatttagttatttagtgtctgagctgagttaacacagggctatcagagtatgaatctcacatggtagatatgtaggcatcatggaacccaacagagataactttggatggggatcttttttggcattcttcaaatcatgccctgtgaacaaccattactctgcctccaatgaggtcacaccctgctgtctatcttaacatatttgtgttgatatctctaataattgaggatgcaataaattctagttctcttcttcctgcaataatatccttccccaaactatggccctagaatcttcaaaagtcttgaaaatatttctggtaaataaatgttccccattcaccatccatccctcatgctcttgcagggccctcctcagacacaggctggcggaagcagatctcctaataccgattgctgagttagaggcagcttctccccatccatcaattctaactgcattcaaacattttcaatatgtgggctccttgataactttcactgtatggaaaacaaaatggagggaaatgattattggcacaaaagggggaggccataaatcttcaaatcagatataggacagattggaacaatatgggttctccaaggttgccatgataatgtacctaataactctccttgggcaaaaaggcaatctgctttcaatcaatctcgctttttttctgagcaaaaataccaattacgttgaaggaaggttttttttcttccttttttgataaagacagctctccaccccagaaatcatgctgtggctaaaagatatatattttcaattgtctagaatggtattggatagctagcaccaaatgaaaaaagtcaatcctttttttctcctcactcttgccagcatttgtctacttcttaagagaagtgaaagttaattaaaggcttaagggataatattgattgcattggaatatattttatatgtacccagtacattttcaaggaagagaaccctgactttttctaaggctgaataaatcagccagctgagcttttgattcaagggtgagaggggggaactcatcttttccccttgcacttctcacacatctttcctagggatgaatgatttcagagaggaggaggagatgctggctgatgttcattcagttctttgcatgctgggtaggaagaacgaatgttcaggcatttccccagacctatcattgatttgagcctagctttgagtaataaccaggcttatgctggtatagaacttcgaactttacaatgcctggcacaggaggccggctgggtggtattaacctctcagcttcctcctgcactgaatgggaataaatactttgcccacacccttggtcgcagagcagggaatcacatctggcttactttcacatctaagtgatgagaacagcctcagccacgtatctgtcctgtggagatacccacgcattggattcatgttggctttgctcctaatcttggaagtctatgtgcagaggatgttagaatggcaaagtagccctattgtcagttgcaaggaagttaggtcagtaggggaattctgtttctcattcacttcaaacatatttggcaaattcaaagtctgaaatcttattcagaacgtgcaaatttatttgaagtattttgtccatgtaaatgtacatgtgccacaagaaacattttaaaatatatgataaaatgcatatcatccaaatgttcaatctatattgtgtattctgatacactgtgtgtcacactgtcttagcctcatactactcaccatatactaatgagggggttagtcatatgggctttgggcataaaatttgggtgggtggctaagggaccttcatcaacctagcaggagagcaaagtgatcatgttaagacatctcttctgaagtagctcattgacactcttccctcaccttggtggccgctgcgtgcctgattgctaagtgcaccaccgtaacaataacagtctataatggtgatattattaactgcatcgtgcatattattgatttactctttgttctgcatcattatcctttcaccaatgagtttactgcattattctcacatacttagtcaagcaccaaattacaacgaaagggcaggctcttataatggcatctaatggaacattgcataagccatcatcactgcctcctattatgagccacctccagccaatgagctttctgccttagtggaatgtgcacagagcaattatgaagtgcaagggacatggccattctaaattttacccaggaaattaccatgctgcatgttcaccacctgcccaagtctcagagcgcagctagagactcagatgctgtcactatgagcctggggggcacagggacaggagttgagcctcttgctacatacagtctcttcactagaagccagtggttttatctccacagtcagtccctggctttttgtcttgtggctgactcttgcatcaaatgctcactcctgactgggcattatgtggcacatataagtggccatgacattgcctggtgccaaagtcagattggccaggagccccgagcggttggagggactgtcagtctcaacagttgtggggctcatctcttccgggtgagccactacttccagaaacagaagtccaaaccaccctcaaacaaggcgagcaattccagcctcatcccttcccagcatctccccatcttgaggtaaattcctttagctctcctggaaatcccgggcaccctaaggaagcagccctctggggacgcacagccagctggcatgatcttccattccataggcatcccagccccatttagccctgagtaatgctcacttactgtaaagtgttacatgcccccattgtcggaggagttatagtggaaaaatgcaaaatttcctttttactgcttatggccagcagaacctataacgtgtcaggccgcacattagccaccctgataaaagtctgctttcttacacacaaaatcatcgtttcagcaagatttgttatctcattacctgataagctctatgtcataaaccaagactcatacagtaaatctccccggaggacgctttgtgggcagaaagggagagatatgaatctgcaagggacttgataatgcagcatttaagcacaagcataatgtcacttattgttaaatgcataaaaccacttggccaaacagttgggcttttaataggattttgtgcagcatcaggtgagaagccatatggcttttctgtctaggagtctcagcacctgctagcaccgctgctttgcctcactgccctctggggatgggagctgggcttttatggaggcggagggaggagatgaatgcttcccctgcagctgcctggcttctgctgtcttgccagggggtgggatgcagggtcctgtcgtggtgcctggcctgatctaactggcctctcctgttcaggcacattgtggtctgcggacacatcactctggagagtgtttccaacttcctgaaggactttctgcacaaggaccgggatgacgtcaatgtggagatcgtttttcttcacaagtaagagcttcctactgctgtcagaccctctgcccaaccacacaccctgcgagggactccctgaatgtctgtaagagtggaggtcttggggaatggcactggggatggggccagagttgggtaagccatgatcccttttggcctcgttggagaagatattgcagaaccaatggaaagggaagcaacacactggttcaatgatgagagcagagtctgcctctgtggaggcgattctgggaccacatccgagtttatctctggaagaaataatagtggagctcattgtgggtccaagtcatcatcattgtccccttagcaatctggcgtgtccacattatctgctgtgggatgattagctgtatggtgtggatacgttaggagttctggagtcagttggtgaccaagcaagacaccaacttaagaggaagcaggacagaaggtaatagtaataacaactgccgttcctaggaacccccagcatgggaccctagcccgtcactgtgcatgcaggctcccatttactccacaaacagagtaaaaatacatattctggactcagattccctgatctgaatcctgactcaaccaactactggctgagcaagttacttaagctccctgtgcctcagcttcctcatccataaatcatggagatgatagtagttcctacctagttgggctgtgatgagaatgaaatgaattaatccatatgaagtgtgcagagcagagtcaggcgtgcagtaagtcttcaataagtgttagctatcagcctgaaaaataacatatatttggttgtataatccacttaggaggtaggtcttatcttgtatgttttacaggggaggaaagcaaggtatctcccttctacccaatgttgaggttttcaactttgactaatcctctttttagataaaaggtagtctgccccaggaatggagagaattagggggctccattatggtgacatgtgtggtaccatggtcatcttcttttatggagatggggctgtcatggggccagtcctggcaccacatcgcaaagtccaggacaaagctaacatgtttgtgctggcttgacgtgctgttgactacccagcacgcggtcctactctgaggttccactgaggtcggcttccctacaaactccctgtttggtggatcgtcgtcctctggcatttgctcacagaatgctagacttctgacttgtcaccatgttggggcaccaacatttctcttttctgcactgatttctccaaactttgaaaaaacagaccaggctatgttagcacaggagcaggtacccacaggttccattcagtgcttagccactgattacctgctgtgtggcccatcctctactgagcgttttggaaagttctctagaggtatagtgtgtaggctgtgcccccacatgagttgggcatttcaagatgaacacacatgcaaccattagagacaacatcaaccctgtgttatccaagggatgctgaagtcattttgatcaggtggcagaagtgactggggacatctctttcaaggagcatcagtctatggtattacccgggcaggcttctgaatgaggtatgacttgtcatgggtctgaaagactggtcagattcacagaggcagccacttttctctcatccactgctttagtttgaataaacaagctggtaaggtgtggttgctcatgcttgtaatcccagcactttgggaggccaaggtgggaagatcacttgagctcaggagttcaagaccagcttgggcaacacagtgagaccccatctatacaaaaatagaaagattagccaggcataggggcacgtgcctgtagccctcgctactctggaggctgtggtgggaggatgacttgatcctgagaggcagaggttgcagtgagtcaagatggcaccactgcactccagtccctgtctccaaaaaacaaaacaaaacaaaacaaaacaaaacaaaaactggctgctcatgcttccattgctaggattcacctttgtatccctaacatccatcaatgtcatacttatagtagatggcccagttaattaacctcttgaagctctgggttaataacatacctgcctatagggttgttttgagatttaaatgaattaatgctcatcatggccaggcatggtggctcatgcctgtaatcccagcactttgggagggcaaggtgggtggctcacttgaggccaggagttcaagaccagcctggccaatgtggcaaaaccctgtgtctactgaaaacacaaaaattagccgggcatggtggcacatgcctataatcccagctactctgaaggctgaggcacaaaaatcacttgaacctgggaagttgcagtgagcagagatcctgccactgcactgcagtctgtgtgacagagataaactctaagtaaaataaaataaaataaataaatattatttattttacttatttatttataatactattttactattatttatttaaaatgttatctgccatatagtaaatgttacaaaacatgaactattattattattgtcattatggacttcacaaatgttaggcaagtgttgacttatcacggtacctggcgtatagtaggttctaactaaatatcatctcccagtgcctagcacggtaccttatcgacagtctttttcatctctgcagaattaacaaatgaataaataggtcacttgtttaatccttgtcctccaaagagaaagatgtcagtacagatcagcaccaagaaatgtgatgagtcgcatacatgtgtgtgaatcaagaacaataatgagagtaaattaagtctgtctgtggctcctcagagtgatactttttgatccaggccttgggggatgagaagtccatgagacacagaagcagagataaggttcatgatggagggaacagcaggatgcctctcccaggggaaccttcggctaatccttgattgtattagtcagggctctccagtgaaacagagtcaataggaaatatatatatcaatatatctaatacagatatatatcggtatctatatattgatacatctatctatctatctatctctagagagatttattaggaagaattggctcatttgattacagaggctgggaagtcccactgcctgccaccagcaagctggagacccaggaaagctggtggtgtttgagtctgagggccagagagtcatagagccaatgtcaaccccagtccaaggataggagaatgacaagagatgcccagttcaagccggcaggaaagaagcaaaagggacaaacgcctctgtcctctgttttattgttctcttcagaccctcaaaggactggatgatgcccactcccacaaaggagggtagtctactgaattcactgattcaaatgccattctcatccagagactctcccagacacacccagaaatcacactggatctgggcaccctctggcacagtccgcataaaatgaaccatcccactagtggcgcagcccagcttccatatttataagataggaattccattcataccgaagagaagacatttgtcctgaggtcttggccttcctaaagcccatgaacctctttcttttaccatggtactggtttggttttcagttgggctggggttttacttctcttgagtgtgagtcttttatttatggcaagcaaaagggtgactgtaggtcacagcctctccccagggctccctgtggaaattagagaggaaggagcccatggaggctgaaacccccgagtccattaaattaatagcgatttcttctctccctgtgtagcatctcccccaacctggagcttgaagctctgttcaaacgacattttactcaggtggaattttatcagggttccgtcctcaatccacatgatcttgcaagagtcaaggtaaggaggaagaggtgacttctgcttttattccatcttggtgtgggtctggggggagtcctgactctgtgctgaggggacacacctcctaggttggccacgagtcatctcctaaacacctaatgagatcaatcacataccagcaaccttgaggtcacccttccactggtcccaggacctccttctgctggcatatgcaacactacctataaccatcccacacttggactggtcataacatgaaacttgctttgctggattcctcaaaatcagctactcatcaaggaagtagaccagttatatggacccagtagctttatacaacataataatcaagtaattcctatattgaacacttaagttggactcaatatagctctgacttctattatttacatctgaaagaaacattaggctaaaatataaaataaaattttactaagcgataaaacatttgagctttcttttttccccatctaagacgcagggtgtaaaactaaacatgcagttatctgatatcattgataatgggcgaatctttttttccagaaactggtaatttagaatcttctcataaagcacacctgaggcttagaagggaaaggtacaaggcaaaatggcatctgctactttacctatgtaatatagattttgtaagcatgttcaatatttgcatgccagggggtgtacattaatataatgaattcactgaagtctaaatgctaactgtggtcaccgcataattttgtaaataatataattggccaagatgaataatccaaaaggatttggataaattctttctttatattattaaagaaatcagagatgatttgtgacataccacggaggatattatggcctccctcaaaatccaggaatgatctattaagtataacataccaagtaggacagattgcagacctgagccagcataagaattcttatgctcatagagtccagttaatcttgatattatccagacataactcaagttattgcttatgtaaaatcttatgagaacgtagggacaattgttattgttcgtggacctaatttaaatgcaagcaatcattagcacatcaaactcatggtcccctctaaggaataaacccctgtgggctcgtgtttggataagtcagtaggtatattttgagttcaactgtaacacattatttcatacatagatttgttgtcttctgaatatctgaatactaatcggatactaagcaatatggtgatgttatctgatttagagctctgatctcttcccagcctatagaaaatgaagatgtgaaaaaggtcagatgaaggacttcagagtgtacatttctgaatccccaatactcagttaccttgctaactggagagaagggatttaacccacccacctccaactcctgataggaagaattaggatgatggtgcagatggttgagaaaggaggtggggaggagactgaaaggcttaattaattgttatttaaagaaatctggaaatcctacaagtaagcaacgatgccaaatgaaaagtataattaccaaggtacatgttgtaccctccaacagcaacaagatgaaatgtttataccataacaagaacttggaacctacacttttgacaaaaactataatctctcaggctctcaggattgttttttttttttctttgcaaagcttccccaagaagctgtcaacagagagagactacactcgagcatggctatttatatgtttgtgttctgtgaattttcctttcggtgtcttagatagagtcagcagatgcatgcctgatccttgccaacaagtactgcgctgacccggatgcggaggatgcctcgaatatcatgaggtaactcttggggcgctgcggaaggccctgggcttggcagtctgtggctgttcacggcccttttggatcttctgcagaggactatctctatgaggcctttttgccccacaagccactgtacaactcaccagctgcataggcctgggggagccgaggctgtctgtgtgggttggggcagtggcacacagggtgtcaccaaccggaagctcaccctcagcaggtggcagctctagggcttacagctggccttgggtttgagattccttgagacagaactaggaaatagattgagatgggtgctggcctgaattaaagtaccatgttccctaaaggaaatgggcctgagatatcttaactaaaggcagatgcccccaggggacattttgcaatgtctggagatgtttttggttgtcacaactaggggaccgtgctgctggcatctgataggtagagcccagggacactgcgaacgaccctgcaatgcacaggtcagcccccaaaacagagaattgtctggcccagaatgttaatggtgtcgaggctgagaaaacccttactagggctttccaagtgtgtctacggcatattgattcctatcaccccaaaggggaatttagtgaccagttaggctgtttcatccagtttcccaaaattaatgttctttcttgaaaggcttttcagtgcttttaatactaatatgcatctctgagataacgtactatagaacactttccaaacctatttgactataagcctctgctcctctcccacctcccccaaccccccccctttttttttcatagagacagagtctcgcactatcgcccaggctggagtgcagggactcaatcatagctcactataaccttgaactcctgagcccaaacgatcctctcacctcagcctcccaagtagccgaggctataggaatgtgccaccacacatggccaatttttagatttttttttttagtagggacagggtcttgctatgttgcccaggctgatctcaacgaactcctaacctcaagtgatcctcccacctgggcatcccaaaactctggattacaggagtgtgccgctgtggccctgccctgccctgccctgccctcccttttttttttttttttttttttacagaacatctaggggaggtcatactgggaaacactgtgcagtgctttttgtgcacaagggttaggcctgtcaactgctaatattggccccaacaccagcaccttattcttttcttaattcagaaaaaaagcaattgttcagtttttgttccttgcataaacccagtagtcacattgtgtgacaatgaaatgactaaaaagtcaaggtattttgctccaggtagttagaggccctttggaatttgtcttttctgtagcataaattgcagaagagttaagagggctgagaggaaatgataaagggaagcttctggagagttgagctaaattcagtgggatttccgtcccactgcattcccaggaacttttacctaactgtgaacagccatctttcgggccaaaggttccccctctaccggtggcttggtttactgcctcctgggaacttacctgaggttgaaggtcaagaagttacctttacatcctgacaatgtttgcattgcctttgtctttgctttccatcagtggccccaagtgaccggagcttccccatcagtgaggtgggggaattcctccagtgcatttcagaggagccagtcctcccttaagcatctggtccttgtgtctggcaggcaacatctggcaccatcttctcttgccactcagttttctttggcaatatgcttagtgaggtcattttaaggaagtggatgcgtgaactcttctaagctttgggcttgccaggctgcagagagagggtggaacagattctggcttcacacctgggctcattcccgaatcagttacagctgcacagtggctacaccaggatcagggttgggtgtgtcacttgttcctttctttgaagtaggaaggattttcaacttttgacacctttttctgtcattggaaatgatttaaaaaaaaaaatgtaaccctttaaggaacctggcttcactgtcttcaaaattccaaatggaaaaccaaaagaagatgaagcttaatgttttgactccacagagatgtttggggctacctgagtaatagttttgaaatgggtgtttctcttaattgtagtattttatttaaaccctaactgtggtagggttaatatgaagacacataggtactagggtgactggcaggacaaggaggcatagaaattactggtcaagggcggggctcagtggcttacacctgtaatcccagaactttgggaggccaaggtgggcagatcacgaggtcaggagttcaagaccagcctgaccaacatggtgaaaccccgtatctactaaaaatacaaaacttagctgggtgtggtggtgtgtgcctgtaatcccagttactcaggaggttgaggcaggggaatcgcttgaacccaggaggcggaggttgcagtgagccaagatcgcgccactgcactacagcctgggcaacagagccagcgaggctccgtcttaaaaaaaaaaaaaaaaaaaaaaaaaaaaaaaaaaagaaaagaaaaaaagaaattactggtcaaaggtagtatcagaaatgtaattaagtagagccagaactgaggccttggctgcaaaaagaagtgggaagttcagggttaaaaatgggctttgtctttctcttatttgtataatcctccttcctcctcagtttaatgagaccaatctgcctcctttgaaattaaaatgtcaaagatccatttgaaatgagctaatgcagaaaactggctgaagctgtgaactgcaaggcagggctgacagaggctcaaagtccttgagttataagcgtgggccaacgcaacactttttcaaaaataaaatgaaatccttcaagtgcaaaaacgcagggtgaatttgtgctgggagaggctttagcgtgatccatttcctaaattcgtacgttgcagcttttcagataaagctgctccctggctgccttctctccatttctgcactaaaaggggtgaagtggggagcgctgctgggtgggaagtttgtgggggtggtcataataaatgcacttgcatttctgattaggcttaggaggtgggcctttctgtggaattccattctttagccttccttgtcacagaaggaaatgtacaatgtcacttctgacagacttggtaatgacaaaaaccataacttacacgtggagagaacttttaatgatttcaaagcattttcacatctggtctcccatttgctgctcataccaagcctgtgaagtaaataaagcaggtactgttgctcccagtgtccagatgaggaaacaggaacagagagcccagggttttcctaaaggtcgcgcagttcattagtacaatagctgtgactggaacccacgtgtttccattcatctgcgctctgcccctccctttagcaccataattgatgtggggaggacacgtgaggcctggggtgggtgcaggccatgcttaacattgagtttggactgagggcaggtaggagacaattttccaccagatcatgacccccgcaatgccttggcacttatttttaaccagcgtttaagtcatcattttctctattagctatggaaggctgagtccttgatctcatcctaaaagccctgcttagaaatcattttttgtgatagtggccaagcatgtgtcacaattagaaccatttgtcatcctgcttgtttgatttgtcattgttgtctcaagttgttaacttggagaattggactcagcagattgtttctgggctagtccctagggtgtgggagattgcaaacctctggaggccccatgatttgggctcgctttcgatgtctacgtaggcaataagctggcagcccctgctccaggccccctactccccagtacgcacatgcatacatcccatctccaatgcattccaaggggccctcaaatttttcatgcccaggacacagactgtggctgttttgtgattttgttttcacactagcaagaggtatggtggtgggaatactgtttaacctggcccagtgtctgcaacccctcaggatagccctggctgctggtcctgatgcaggataggtgagccccaaaatggggcttagcccatgaaggtttttagcttcccccagaaaagaattcaaaggcaagctgatggtagggcagaaggaaacagctttattgaagcagtagtattacagctctgtgactgctcctgcacagcggggctacaccatagagtagcagctctgggcaggctgtcgtatttatacctacttttaattgcatgcagattaaggggcagcttatgcaaaaatttctagggaaggggtagtaacttctgggtcaccgggtcattgccatagaaaggcaagtcccatgagcccagtgcagatagaagcaagttctttgagctttctttctcactgtccacccagacacttaggcaatcatattaaagggtttcctctttcatggccttctttgttcctcatggtggcttccccaaattgtatgtagtgagagatggaactgggactggaattcatccatgcattacaacttgctttcaggaaaggacctggtatgtgcctgtaaagttatgtcactatgaacatattccaagagatagttgatttcataattggacaacgggcttgaaatatgaagcatttcaatcccctatgatctagtaatagtaatgttctagggcctagaggttatagggaacctcctgggtgttgccatggcaatggtaaactgacagggcacactgctgggcttgtccagtgaaaagttgcttctgccccatccctgtttcagctagtcttcaattttgtctggtatctgagccctgcctctggaatcaagtcctgcctcctacctcagtcccatgggtaccccatttggagacagtaaaattgatctttttgtcagacaccatgcataaggcagacctgtctcagcattggttctttctttttcagagtaatctccataaagaactaccatccgaagataagaatcatcactcaaatgctgcagtatcacaacaaggtaggagtgcgagagcccgctccaggtctgaagacccatccacaggtccagcctcttcttcctcattatacaggctcacacacacacacacacacacacacacacacacacacacactctcacatgcccacatgtgcgcaactcaaagacctgggtaaagaggtgtgattgttaaaaatcttcctgggacatttctttctttctttctttttttttgggatggagtcttgctcttgttgcccaggctggagtgcaatggcatgatcttgactccccacaacctccacctcccaagttcaagcaattctcctgcctctgcctcttgagtagctgggattacaggcatgcgccaccatgccaggctgattttgtacttttagtagagatggggtttctgcatgttggtcaggatggtctcgaactcccaacctcaggtgatctgcccacctcggcctcccaaagtgctgggattacaggcatgagccaccacgcctctggcccatttctttagtccaaacaacgtgtttgcatttggtcactggaaggatgctccttcatgtactgattcattcattcgggaagtgtctattggaacccgaggttcagaactattgatttactcttggatcccatccatacttaagttacaacaacttttatttgtatgtgctgcagtcatttatttattcagtaaatatttattgaatacgtactgtgtgattagcactctccctgacacccacaggaatatcagtgaaggagaagccctattttgtgtcctcggggatttagcagttaaggtgtagaatgctccaggcaagtgagtgataggatttctctatctgagaccaggtgaactagtgagtgcataatgcgctctgtaagagtgtaatgtgggacacattcccagagtcgagatgagaatttgcagagttgaatcaggaaaatagtaagctatccagagattaaagagaaaggaattttccttgtgttatagcttacagtgggggattgattagaaagaagacaaaagtcagagtctatgctgtttccctgtgattacttctcagtaaaccagagtccagtgtctcattcaaaggcagtgctccttctctcggccagtcaataaacttccaaaaaaacagctttaggggagggaaggtggcacctttctccatttgatgcagtaccagttatgtccttaatgaaacctagaaaccggaggctgcccagtacctggagccaggtgtcctgtctgtacagaataactcgctgctgggttatgagtaacagcgtaccccctcttatgggccatattccctatgaaataggcagtcaggtgatgcagagaaaaaccccattctgccaaatgcaccagtgccatgccgttatttcttaattgctggcaagtgctggcccattttgctgtgtggaggcccatcagaggctgtcactgagtggagcctgctgtcagtgactggcccaccatccagaacggctgactgctgccagccactgcccagccctcggcaggtggctcccttgcagaacgtgttgttctccagccaacggatttggtggtgggcacccaaggtcacattcgcctgtttgtctctggaaaacccaaggacactgaagagataaagtgaggatattggtaatgtacgggtgtcaagctggagaagtttttgatggcagcccttgtaggtggaggtgaattttattagcaaggctgtgactagtgacagctcctgcagcaacgagctctccttctttcatttgtgatctgaaatttcatttagtgtgggagtgctttaagctgttgtttagatttttggctgaatttagattgaataggaaaattaatgttgtatgtttagaaggggttgtcagttccttttttttctctttccaatgagtgctgatgcagcatcttcaagaaattaaggaggattttagctgtggttattgtccaactcaaagcagctcagccggcctgggatccagacagtccctggtcagtaatcacatgatcatagcaacctgaatgtgtttggcaaacctctgtgttgtaattattcagaaacagtgaggaagatatcaaccaattcatgattatttgcttaaaacacattttgtttagaaccatcccaaactattcgagttttggggttgggcagaatcacttacagatccttggatgattagtcaggacacagggaatagagtgactttgacacagggcattttgttgttgttgttctttcatatctctcttctagagaaagaagaaaacgtccactcatcattgtttgtctttcattccttgtagaattgcaaatggacattcttcaccttgcttcacagttttgctgtgtttcctgagatgtttcctactctttcaatacattttcttcctcttccctttcaacattttttttctgcctttcttggcactttttgctgcactcatcctagatgcttagagatctccatgcattacaatttgctttcaggaaaggacctggtatgtgcctgtaaagtcatgtcactatgaacatattccaagagatagctgatttcataattggacaacgggcttgaaatatgaagcatttcaatcccctatgatccagtaatagtaatattctagggcctagagggatgtagggaagctgcctactttctctccatgtaaaactggccctgagtttgtcatcatcataattgtagacatgtgtgtcatattttatggttttaaaagagctttgacatccattatcttctttagtactcgttggaccatctgtgcattttagcatcccagggtaacttcagagcagggcatctaagctctgtatagacagcgcagctctgctgggcacaaatcatggccaccactctgcagccagcgagcggggagacagaagagcttactgccaccgactctttaaatggagccacagcccattgaaccaaactgtggttcccgagagtaggcattatagaagggctgatgctctccaaagtgtatcttttaatatcactagaattcttggagagaaacgctttcatgctggccatcttttaaatgctggccctgcatcttctgatttgagtgtaaatggctcaaagctcttcaaggaaagattggtttataacttcttggaaaagtatcactcctgatgatttacctctcagtggattttttatttttcccaaagactctagtgaaagaggcctttatctctggaagccaagtcccatgagcccagtgcagatagaggcaagttctttgagctttttttttccactgtccaccctgacacttgggcaattgtattaaatcgtttcctctttcatggccttctttgttcctcatagtggcttcccaaaattgtatgtagtgagagatggaactaggactgaaatccatctctcctggttttccaggacagcgtatttccagttccttctccatgagaggagggaggggtggtgaagtagcagaaatgaagggcagccaggtctgccagacctgctctttatattctccaagttagggagagaggatttgcctccagacttctgggcactaacactggcatttttcatcagactcaatttacttcaaatggaaaaggacgaagtttccagaaacaaaggatttatgttcctgggtcagtctcttctctttgtttcatgcacagagatttccctccaagcattcagcaggtcaccctcactccttccctgcgttggagaaaatataatatccaaaaaaagagggcacagaaccctgagataaggaacaaactcaacttttctatataatcacatggccaagtgtcaaggtggacagtgagaaagaaagctcaaaatatgcctacagaactcaaaccagacagggccatgggggacccaaggatgaaatgcctcagccttataccttagatagcacatgcggataggagagactttctctgaaaggttttgcttgtttgtttgaaggtgccatgaaggttcagagctgtctctttagggcttggaccaaaaaaatctcctttcacacacaatgcttgacttgttcattacttaaactgaatttctcctcattcctctcaggttctcagatgatattactgcaagtgagtatttctccagttataccaatgtgttctctacgatgcccaggaagtaaaagggaaagtggccatctgaagccactggagagtagggagaggaaggaataaagggtagggctagttgttggaattgagtctgcagtgtggggaaggtcctttgatagtttgacagcaattaccacttgctgtggcccctccatgagactatttaaccatgctctcatcagggagggcactgtcatctctccctggagtacccacttttggcttaggatgcacaagattgtcacagaagcggattttgcaagaaggaatttcacaagaatagtatttttgaaagcagagtgtggaacccttggacttgctctttgttttcacaatggagtcttccatccttctagttcaactattgtatattgttctgaaagtgaagggaatgctcccttggtgctccttgtgtttgctgagatgtgcagagaaataataacttcaaagccatagaatcttggcactagcagagacttagaagggctctctgattcaacctcctagtgcagagcaaaagttctttccatagtaacttggagaaatacttactgagtcttagggacaaagacctttcattttttaaggtaaccttctccgtttggtagacaaattacatccttaggaagttcatttataaaacaagacaaaaatctgctttcttggaatatataccagtcagtcttaattctggcttctagaacaaagcaggacaaacctaatcttgtacacagcagcacctgaagtattcagatgtaaccatcctgtctctgtgaggacgagagccttcttcaggccaaatattactggctgtcttaactgttcctcaaaagatcttttccagacgctacctcctcttgtctttgtcacttttctctggaagttattcagttgatcattttccctctttaaatctgactgaaaactggatcaagtactctggaactagtctgaccaattcacaacagaatgaaatgttcatttcccttgatctggggagcacttctaaaaagtaaacactggctttctctgtaatgtcacatggctagcctaaaatttgaggttttagttacccacacacttaaatttagctttgtgtgttttgttttcttttatttctctcctgcctgctgccaagctaggtcttctcattttgaatttatatagttgattttttttagcctaaatgctgtacttgacatgaaagccttgtaaatctttttagtttggtcttttgccgatttttccaactctggagaaccttttgaactttgattctttcatccaatgtattttctatgactctctgcttcatgccacttaaaaataattggatgagcatgcctctgggttcttgtctcagggcctgacataagggttgaataggaccagtccatttgcaagagattggaaacgtcgacactgtgatttacctgatgttttaggccagtggttctcaaagtgtggcccctagatcaacagcgtcagcgtcacctccaacttgtgagaaatgccaaattctccagccttaccccagatctactgaatcagaaatgctggtggggggccagcaatctgtgttttcagaaactgtacaggtgattctgatgcccgctcctgatgcctgggagtcactgatctggagtattggaaaggcaggtaaaaaagaaactgaaaatatacaggcatttggcactcctacggtctattagaggactcaacttaatgatttagctagacatcctagtaacccaggctgttgggtctgtcacaagaggaaattccctctgggctctatttggctaaatgacaaacccaggggaggacttgggcttggtgggtgcagaagcaacagtccagagagactgaagtgtgatgagcagaagagttgcataaaacagcaaacatcagaccgcagcaagggaaaagaagggcaagactggatggccctgagtggttgggcaatgctgcatttcccagaagaaatgttaaacaattgaacatttaacagagcaaggtctcatacctgcttttctttccccaggcccatctgctaaacatcccgagctggaattggaaagaaggtgatgacgcaatctgcctcgcagagttgaagttgggcttcatagcccagagctgcctggctcaaggcctctccaccatgcttgccaacctcttctccatgaggtcattcataaaggtaacgtctcgtcttattagagcacattagctcgggattccatttgtcgtggggttgagtagagagcacagcttaaactcaaaacagatcgacgggctctaaccacttgggttaaggagaaattccttgttacggatttgggcatgaagccaacttctttcaaaattatgtttttatttttatttggcacatccacggccattaaatgattgttcaaagcacaatcccctctttttttagataaaccacatgtttatctatcaacaaagcctccgctgttaaaacaaaaatatgatttatatacattccatatggcaacagagcgcctaaagaaaagaattatcattttgctcttttatatcaagtggctggtggacctctcactgtgtggataaatgcagaccatgtgtttgtgctgaagcccaaaccccaacagcataattcatttatttatttctgcacaatcaaggaggccagcaggactgacatgccgcggttgtttgaatggagagcgaaacaatgtactgagtcctcggcagcagtgccctttgcaccgagagacaggcggtctggatgtgttcatgtccttgtcagagctggctggacagacactccagagtccccaaggtggccatacctgctgcaccagtgcaggcaaggagagaaaaaaaaccgactctgtcctcccagggtgggccaggttaggattgtgtttccagagccttgcattgatcgcccagccactagcaagggggcttctggagcctgggataacagtcactccagtcctcatccttagactgttcttagattaggcagtcaaggtgacaaacccgtgtgtaaaacgggtctagcttgagcctttctgttatggcatgggaggcagttagctctggatctgggcttacatcttgcctcttactatgtaaggagcagaattaatagctggcaaggtgggaaattacatccttagaaagttcatgagtcagcacgaggtccataaaggaggctggaagctctgcaatcaaaggtatgagacctcctgccttttgctgtcatgtggctacctaattgactgccaagttccttgatggttttgaggaaatggcctaggttgcaataagagggatgggtgggaagcatgaggatacagatgcattggtgctcaccttgggcacctatgagtgatattatttagagcaggagtttttctaagtccttatccttcgtacctgccaaatcggcattatgtagccaactgatagttaacattgctccacataaaggaacaaattgctttggagctccttcaatcactttagcaacactgatagcaagggataccttgatttaaaaaatcctcctatgctcattatgcagccaaaggtctcagctcagcagaactctgagctcagatccagcttacaaataaagatgttgcattcctttaggtatcttctttaatccaggctgctctcatcctgcatgggtggaactgaatggaggtggcagggaggtctgtgtagctgtgtttagagacgagaccctgaagccagatgtagccacgtgtctcccagggatcttatgttcaacatgaaaagcccagactcaggataaaggactgtcaccacgagaacttctctggctctttcaatcaagctctggtggttttcttccagggcatggcccatgggaccaagcacatggtgtgtggagctgtgctctgcttcctcgtgttgatgtaacatgggctttggcagggccccaccacagatggggccccttgacatgcgtatgttttgattttgtggtgcctgcatggtaactagagctgtctgtcaaggaaattaataaaatggatgtgatgctgattcttcagtgctattagcagcagggaaaacctctgcccaaccttcctccagaccctgatgggcctcacctctaaagccaaggatgtccgctccagctcagctaatcccattgccaagttcctatttaggaagagcttgtgggaaaggctgggcctggccctggtgtaactgaaaacacattttcctctgggggttatgttaccacattatttctgtataaggccaattcccgcctgtttggaagtagctctctgaatatgaccttttgacactgagatggtctttgtgttggaattggctaaggtacatgacctggaaatcacaagccttcccctcatatatttttctcagctaaaatagagatgccttattcacatgctccccattctacattgctatctttgtgtacttacctccaaatcccagatcttcgtctcctttaggtcatggtgaacaccataatggcaccctccttggcatgttttatgtattatctcccattccagggatcacaaagccctcacttacttttgttgggggtggggggtaggtggaaaagtaaacctacaaatggattattgtttacagaaattgcttccttctccaatgacctccgtatcctatgacggagaattcatcaatatttccatggggacaagcaggcctattaggatggacaaagaaggggtgaggctttggcagcacttgatcctttgggaacaattagcatttctggaagccaaggtaaagtgttagctcaccctctcccttcccctaggccggtcgtgtctgttttttggtgcggcagaacccctgttaaaataagagaaacaagactgtaacagcaaagatgtggcacaggcagaagcacagtgactatccactgggctttttaattttattttaattttttgtagagaccagtctccctgtgttgtctaggttggtctcaaactcctgggttcaagcaatcctcctgcctcagcctcccaaagtgctgggattatataggtgtgagccacttccactgggcattttatcatgcatgagaccaaaatgccaagactgaaagtgggggtgatatgtttaataaaagaaagagggattactggccaggtgtgttggcccacacctgtaatataagcactttgggaggccaaggcaggtggatcacctgaggtcaggagttcgagaccagcctggccaacatggtgaaatcccttttctactaaaaatacaaaaattagctgggcctggtggcgcatgcctgtagtcccagctactcaagaagctgaagccggggaattgcttgaacccaggaggcggaggtcgcagtgagccaagatcatgccattgcactccagcctgggcaacagagaaagaagaccccgtctccaaaaaagaaagaaaaagaaagagggactactggcatacaggaattacaaaagaggcccagcctggaggtaccaagaaatatggagcaatgcttctttatctctccatcaatgccactctcaaagataccaaccttaggaccctaagtctttgtccctgaaaacctcactcctatgtggatatatctctgaattgatctaaactttttaggaatcttttttatattttatatacccccatatctttgggggtaatgaatttcttaactttgctaactactgctaaatattttttttctggctatttgtccttaatttactccatttaaacttcaaggcatgccctctacagcttctgcagtgctaggatttaacaaatcttatgctaattttatatctaatacctttaggaaagagactcaagctggcaatccagggatcctccagctcagcagctgctgttaaggacaggttaagcattttgtgcaataggatcttatttgaacccttgagttcctttaaggagttcgcacgaacatcctggtgcctgtgacttatctgcattcacatcatcagccagccctggaacatgctgttcatttgccactgtctgatctcctactcctagcctgtcaggttctagtgagactctccctgctgtcttctgtaaagacccaggcaatgaacttacttagcctatctgctattgcctcagccctgaataagtggccacacttactctctacttggcttcctcacttggatgtaatttaagatccattgatttgtttttgtttttgtttttgagtcttactatgcatacttagcttctcttcagcgtatgaggtttcaagttggggcatggcctgccatcttcatgaattgtgctatcattcttactaggattagctgtctttgcacatgacaaatctgtgtgctgctgctgtgtcgctgcccaccctctctctgtcctccagtctccccctacactacatctcatatcactctctccttctccaccgtcctctctcgtatacctctcccaccctcccactctcttacacgcctatcatcgacgcgcgtgtacacacgccctcggcggccggcgtcacgaccacggccagtcccgacccgaagtcagctgccgcgacgtgccgacgccaccgcagaatgcagacgctcagcggcaggcgcgcgcccctgtcccggcgactgnnnnnnnnnnnnnnnnnnnncacacacaaaacctggaacacagtatgctctccatgattatttctttgttgaataaatcagttttgagaatgaagaaaatatgttatgtatttctagtgttgtttttttttccctatgccgcaagatttggaatttgcgggtgaaatgttacttaatatcgataacaatacacgcttctctgtcatgttttctgtttctgaatgagaatgcactagagaaatcagaagcatgctattcagattgtatcttggctgaagtggatatggctggacacacaaagtttttgtcctagcactaaccatagccaagggaatcatttaaatatttttagtctgggttatgtttatgtgtatatgtgtgcttgtacatatgtatgtatagaattagtctggtttagcagctaaaaatgtaaatcaaggacttttaataatagctaaaaaatactgattcccatgtgctaaatcccgtattaagtgctttagctgcaatatcacatttaattctcacaatgaccatacccaaacttgtcactattattatcctccttttacagtggcaggcactatgggttaagagaatttcaacaacctgcatgcggatgtgtgatttggaattcacaaactcaggtgttcaaacccaagcaaactggttccaggtttgcccttgagtatactgaaaggaaatgtgagaaacgataagggaaaactttagctagtgccatcatcttagcacaaatcttagctttctatagttcattctatgtgaactattgatgcaatagagatgccctggggacctaccatgttccagacagtgcgctaatcccatcagcatccttaggtctaggaagctctggtaagcttcagaaagcttctgttctgacttggatgtatgggcacatgtttgcatagctccattctgtgcatcttctttacctttctgtctgcccagctctgcaaaagcagaggccactgcatcataacagttaccctaggctgggctgagtcagggtaaggaatgaactaggctcccaagaagggattgacacacactgctgttttgaggaggtgaaactaattggagtctaaaccaagtggagctgaagggctggggatgacttaggtaggtgcttctgggacaaagtaagtatattagggttctctacagaaacagagcaatggtgtctctctgtgtgtgtgtgcacacacatgcgtgagagagagagagagagatgttgattataaagaattggcccacagggttatagtggctgggaaatcccaagctctataaactggagacccaggaaagaagatggtatagtctctgtctgagtctgaaaatctgagaaccagcaaagtcaatggtataagtctagatctgaaggcaggaggagactgatgtcccagcttaagactgaccatcaggcagagggaggaaattctcccttactcctcctttttattctattcaggccttcagtgggttagatgaagcccacccacatgggttgggttgagggttgttgggggagcaatctgctttactcactccacaaattcaaatgttaatctcatgcagaaacaccctccaccctcaaagacacacccagaataatgtttagccaaatatctgggtacactgtgacccagtcaagttaacattaatcatcacagcaagcaattcttattgtctggtgggtgtaagctctgctaaccaggttgaaggaggcataccagaagcagaactcaaccttgcgtggcagggttggagttgacaagagctctgaaatggggccagggctgcaactgataaggctgggattgaggtggctctctacttaggaaagaacaactagtggtaccagagtagagagtttgtctggcaaagtaaacccacatggtggaaattagatagggagatgcaagatgttgcttactctattacccatggacaatgtcaccctaaccacagatggcattatgacagcagacttctgcacatattcctcaccagtggagagcagctcccaatacaattatactcacttccttgataatctcaattattctcattgcttttagatacatagatgacttccatatttatatttccatgaagaacctctcccctgaacccggcgtcaccgattcaactgctgctcaacacctacatttgaataccccatctcctctcagacttaccattccacaatcgaattccttttctttgtccacaaacctgttctttgctcattttactattggcaatgccatccttcccatggctgaaactaaaaactctggagtcacccttgactcatttttaaaaatttatttatttgccctcaaacaccacattcaatacagcaggaaatcctcttggttcaagtttcaaaatattcccagaatcggagcacttctcaccacctgcactcctactactagctccaaaccaccatcatgtctctcctagaatattacaccagcctcctaactggtctgtctgctctgcccttaccaccccacctccaatctatcttcaacaaagcatccagaacaaccttctcaagcatgaatcagatcctgtcactcttctgcataagtctctccatggggtcccatctcatctgaataaagtccctacaatggcctgcaggtcctaagcagtcaggtccctggaacctcattggcttaagtcctgagtgttctcctgcttcttatgttagccacactcccttgggctggtctagggatttttacttcttgttccctctggctggatattccttccctgagcagctgcttggctcccctctgtccaactcttgttgtctttgcttaatattaatttctcagttgagtctttcctctaaggcattagaactgcatttttaaaagggattaaaaatgaattttttattgaaatataataaaagtgtgcatgtaataaatgtacaacctgttaaatacttataccctcagtgctcatgtaaccaggacctagattaacaaagagtacattacaaatatcccagaaccccctgtttttttttaaataagtcaggtgatactacatgatcgggtctgtttctggattctcttgggagaattgacatctccacaatactgagttctccaatctatgaatatggtatatttcttataaagggatactttatgattcaacaacttccctggcaaatacaggaaaatcaggaagaaagtaactaagctcatacaagttctctggggcttgtgagggtctctagagagagtagatgtcccacttcatattctctaggaagtatacagctgttcttctcagcttcattgggggatgaagtttccatgtggaaaaaacagaattgcattttaggaatctgcaccccctccccctccacacaccatacatccacatccttatttactctcttggctttgttttttcccgtggcactctttggtgtttattgcctcttttccctgggacaaggtgagcactgtgaagatggggctacttgctgaatcctcagtgcctagaacagcgcctgactcataatagctactcaatacgtgtttgtggagtaaatgaatgcatcggttggcctcagcctagcctgaccagcctgtattacagacagctgggtgggaccaggaccagcggggacttgtaatttggtgtgattttggtgcagaaaacttctttctttgctactgtatatgattcccttgccaaattaaagagctttgattcaatgtagaaacatgaaatgcaaagctctttaatccttggcaaggattgtgcagaggctggttagatttggttataaagctcttcaactgccagaaaatccagtcagtgtgttgtttaagttcacaaatcaaaataaacacccatgaattgaaatgaatttgctaaaccccagtatcctatttgggtcaacgtcactgtgtacccgcttttcaccctacttagatcccattagatcagaggcttccatgcaggatgctgcctcccgcagtgccactcagtctgaccaagcccactaatgcccacctgaaagtagagtaacttctgtgaaaactatttctaataaagagagaagtaatccatgagctattaacagggattcatttcccctatggccctggtaatttctagaacattgaattaaagcgttctcagacctttacaaattctcaaggcaaacattattagcaaaaagaagcccatacagcatgttagaagatagattgccagaaaatgtcaacggatcttctgaataaaataaaagaagttgaaactcctttccccatcttcttcccttctccctccttcccccaacatgattagaaagtcatttcatgtgtcttatatgtttggtgaatcaaaagcaaatgtacatgattgatggtgacagggaacacatttaactcattattctttactttgcagcaaaatgatttgtgtaaactgtctgcctagcattaaaggtaaagcaaacttagaaaccccaaaatgttatattttcatctaatattttcctcttggttttatagctgtaatcacatatggattcttttatatgggtcttggcatggactgaacaaagagaaaggcagcacagaaagattacataacatatacacagagtccggtgcccagcgaggatggagcccgagaagcggcaatggtcaggacttaatgcgaaaatccagtagaagctgacactcaccctggcccttctcggctggcaggatatagtcactgatgtgaaataagagccatcttattgaacaagcctctggccaagcatcagtctgagctctttcagagataattggcctttaattaattgcatgcattcctgagtccacctgggtatccacagactgggtctactctgcctccccactcttccaactttttgactttggttttttgagtgccatccactgttagtgattgttacatgaaaatcgcaaagtcctatgtaagccataaggaataaaatatcagatttccttaagtctattggttgtcgttgccctaaggtgattttaagtgtgaatctgtgtccagaacaatgatgaggaatttggaactttgaggcaactattctacacatctaggggtgcaaaacaaggaagcaccattgatttgataccgtgggtattctgttaagaactttggaattatagtaatactttacgtttgcacagcacttttcagtttacgtgatataccttttttttttgagacggagatttcgctgtctcacccaggctggagtgcggtggtgcagtctcggctcactgcaacctccgcccacctctcccccagcaacccagccgctgcagcccccaggttcaagtgattctgctgcctcagtctcccaagtagctgggactgcaggcacgagccaccacacccggctaatttttgtatttttagtagagacggggtttcaccatgttgcccaggctggtctcaaactcctgacctcaagtgatgtgcccacctcagcctcccaaagtgctgggattacagcatgagccaccgtgcctggctgagatatacattttcacttaaattctttatttgaccagatacacaaggaaaccagatacatatggaaaacatgccaaatgcaaagaacctaatgtctctgacctttcttcagttgtagaatagtaagccacaggacccatcaccatagctctttgggaggaggaaatcggaagatgacttctggttgcatggctggttggggaatggtagagctagggccagaacgctacaacatcattggcttctcagctcagcgctttccccactgttacacattgcttctccaagagaaatgtcttgaatgtaaacactgctttgttttatattcaaatcaatagcttctaagaatagaaaccactttgcaacatttgtaaaatgagcttatcctaggtttcccctcaaccatgaaaaactataaaaattaagctcttttccaaggtaggagatacatatgtctgccccattcccttggtggtagcttagtctggaaaagacccaggcaagtgctgtcttgtctagaccataatgccttgtagtgggaggatgtattgctcaagccaagggacgcaactgagtacagaagggagatgatgactggtttgttgagggacatgtaagaaagctataaagtttagtctcaaccatttgaaagaaggaagcagtaggttacagtgcagtatgatagacttcccatgtgtgaaatgtgtctgtaaaggggagtgagatccggacgggttaggtagtgctaataagatgaagaaagaaaagtatcttggagaaaaaaatatagttaatcctaatgtttacagacaccttctgatcataacaaaaatattcaagtaactcaagcaattcgagtggaggtgttggggctttggattgataagtcctcaaggttattagcagagtaatccatttgcattataggaaaatgctgaaggtacatgattccagtaagatttggaaatgattatagttttccagaagtgtttttcattttattttttaaattaacatacagtaaagttgattttgtgtatgtgtagtcatgcaaccaccaccacaatcaggatacaggatagtttccatacccccaaattccctcatgctgtacagtcacaccctcctgtcactcctaggccctggcaaccactgatctattctctgtcattacagttttgtcttttcaagtctgtcatgtaaaggcatcatggagcatgtaaccttttgagattggcttttttcatttagcatagttcccttgacatccatccaggttgttgcatgtatcagtattccatcctttctgttgatgaatagtatgacatcttatatgcaggtaccagtttgtttatccattcatccattggacaccatttagttttcctccagttggggcgatcatgaatacagtcgatataaacatttacatggaagtttgtgtggatataagttttaatttctctagggtaagtatctcgaattaggattgctggattatagggtaagtttatatttaactttaaaagaaactgccaaagtgttttccagaaggactgtaccatttatcattcccatcagcaagcaatgcaggagtttctgtagctccgcatccttatcatcacttggcattgtcaatactttttattttaaacagtctagtaggtgggcagtgtggtatctcattgtggttttcacgtgtatttccctactgatgttgaacaccttcccagtggttatttgtcatctgtatatgctttttggtgaagtgctgggtccattttaattgagttgtttctttgaatttgttttttactgtttaagaattctttatatattttggatctcgttggatatacaatttgtaaatatttgcccctaatctgtagcttgtgttttcattttcttaacttaaactttctttcctggaaagaagtttttaagttgaaatatttggagtttttcttaaaaggttaaacattgagttaccatatgactcagaaataccactcctagatatctacccaagataaatgaaactctatgtattagtttcctatggctactgcaataaattactacaaacctagttgctgtaaatatcacaagtttttttccttccttttctggaggccaaaacttggaaactgagtttcagtggagttagagtcaacatggtggcggggctggttccttctgggggctctagaggagaatctgtttccttgcattttctagcttctggaggctgaccacattccttggctcttgtccctgtcatcgcatcactccaacattgtgcttccattgtcacatctcctatttcttcttctttagccaaacctcctctaaaaagacaatagagattacatttagagcccacttagataaccttcctatcacaagatcgttaatcacttctgcaaaaatctacattcatcccacatgcaaaatacattcacctcattcccccatccccaaaagtctcaaccctgcaaaacaattcaagtccaaaatcagagctgaagatcagcaactcacatgtcccaatgtcatcatctaatcagttatgggtgagactttgggtgtgatcaatcctgggacaaaattcttctccatttttggatctgtgaaactagaaaacaagtactctgcaccccaaatgcaatggcaggacagccataggataatggctatagacagtgccattccaaaagggagaatatggaaggatgaaaggaggtaccggaaccaaacaacttcagattccaatatggcaaactccattgagcttcaaggtctaggaacaatcttctgttgcttaaaatgggcattacaaagtttgagtcctccaaatgtattctttttcaaaattgctttggctattctagtgtccttgtctttccatatatactttaaaatcagcttgcctatacctaaaaaaaattcctcctgtgttttgattggaattgtattaaacctatagaccaatttgggggagcactgacatctttactatgtcgtatcttccagtccatcaatttggtctcttcatttatttaggtcatctttaacttgttttacccagtgttttatagttttcagcatcaagattctgtacatgttttgttagatttatatgtaagttttacatttttggagctattataaatgacatcttaaaaaaattgggttccaattgttcattggtggtatgtagaaatatacattatgtttctgtattgaccttgtacctggcaatcatattgtaccggctagcacttcttgcagaatattgaatagagggagtgggagtagacatcttttctttgtcacctgtcttcaagggaaaacattcatttctttcaccattaagtatgatatgaactatagatgttttgtagatacctttcttttgaggttgagggagttccttcccatttctattttggtgagagttttatttttttcaatcatgaatggaggttgaattttgctaaatgctttcctgcatcaatgtataggatcatgtagtttttcttctttagactgttaatatggtaaattacattgaatgattatacaatattgaaccagccaccatacattcctgggagagaccctagttagtgtgattatttcttatacatgttggtggatttggtttgttaatatttttatgaagaatttgtgtgtgtttgttttttggtgtatattagtttgtacgtttcttagactgtctttgattttagtgtcaggtaatgttggctttataaaatgagttggaaatctttcccttccttctgttttctgggagaaattgtgtagaattggtgatttttttttctttaaatatttagtagtatttggcagtgaaatactactaggtttgggcctagatttttttcttttctgaaagtttttaaatacaaattcaatgtcttcaatggttataggactattcaggttaaatagttaatcttgggtgagttgtgacaattcaaagtttttgaaaaattggtctaatttatctgagtttttcaatttatgtatgtagagttattcatagtatcccattattgtccttttaatgtgggcagtgataaccactctttcattcttgattttgttatttgtgtcttctctcttatttgtcactcttactagatataaagtttgctgatctttgttaaataatcggctttggttttattatttcctgtattttttgtttgtttgtttcctttctgcttgctttagatttactttgctcctcttctctagtttcttcttaagatgaagcttagattttggatttgagactcttcttttttggtgtaaacattttgtgctatatatttcttcctggtccctgctttagctgcattccacaaattttgatatgttgtgttttcatttttgttcagttaacaatattttctaatttcacatgaaacttctttgatccatgaattatttagaagtgtgttgcctaatttccaagtatttgaagatattcctcttatctttctattattgatttgtagtctgattccattatggttaagaacctacttggcatgatttcaattcttttaaatttgttaaggtgcattttatggcccagaatgtaatctgtcttggtgaatgttccaggtgagcttaaaaagaatgtatattctgctattgttgggcagagtgttctataaatgtcaattattactagtcggctaatggtgttgttcatttcttctatacccttgctgatttcctgtctgctagttctgcatcttactacgagaaggatgctgaagtctccaattataactgtggatttgtctactttagttccgtcaggttttgctttgtgtgtgtttgaaagtctgttaagtgcatatactttagattgttacgttttcttggtgaattgacctttttatcattatatattatccctatatccttgtaattttctttgttctgaagtctactttatctgatattaatatagccactcaagctttcttttttgattggtgttttcatggaaaaaagtatatcttttctcctcttttttgtttgaaccaaacctatctttaaaacttaagtgatcttcttatagacagtttatagtcgggtgattttttaaaaatcgattctttgaatctctctttcttaattggttgcattagacaatttatctataatattattatttatatgtttggatttaggcctaatattttatttgctttctgtttgtttcctgtttcagttttgaaaattagactaatttttcaaaaactttgaactctcttctttcttcttttgaatcattttgaacattttcagaattttttttggtctgtggtatttcttatacttctttatatagtttttaaaaaattgattgctcatgggtttgtaatgtacatacttaactttttaagtctacttggattccatgatttgcctctttaagtgaaatgtagaacccttaccaaactataggtttctttaccctccccattttatgttatagttgtattatgtattacagctgttgcaaactatatcagacaatgttataatttttgcttttatctattttaaagaattcaagagaagtatagtctattatattattctaatatttattaatgttgttgttttctctttgtttccttccttttagtatcattcctgttctgtttgtccaacttatgttagcagttccttcagagccatgctctggcaacaaacactgttttctgtcatctgaaaatatctttatttcactttcattacttagggacattttggtggatatagaattcagggttcaacattttaaaagtgttgttctactttcttcttgcctccattgtttctgatgagaaatccatagtcatttgaattgtggttacctataagtaatgagtcatttttctccgattgccttctagattttctctttgtctttagttttctgttgtttgcttacaatgtgtctaggcattattcttttgggtttatcctgttggagttcattgagattcttcaactgctaggtttgtctctggggaagttaaagaagttttcacttattgtttcctcaaaaaaatttttttttcctgcaccatattatttctgctttccttctaggattcctatgatgcaaatgctaaatctttttctgatgtatcagaggaccctgaggctctgtgtgaaacttttcaatacttttttctctctgttgttcaaattgcacaatttatattgacctagcttcaagttcattgactcttccctccatcatctttgctctgctgttgagcccattcagtgaatgttttagttattgtattttttaattgtagtatttccatttgatttttaaaattttgatttttaaattatgcatcccgtcttttacttctttacaaatgtgttctttcttagttatcgggaaatagtagttgctttaaggtttttgtcagattattccaacatctgtgtcatctaggcattggcatctgctgattgtctttttccatgcaagttgagattttcctggttactcttatggcaagtaattttttattgtgtcttggatattttaatttttttattatgaaactctgattcttgtttaaattttgtaagaatgttgataattttattttggaaggtaatgacctgctttattttattttactttattattattattgttattattattattatttgagatggagtctcactctgtcacccaagctggagtgcagtggtgcaatctcagctcactacaacttctgccttctgggttcaagcaattttcctgcctcagcctcccaagtagctgggattacaggtgcccaccaccacgcctggctaatttttgtatttttagtagaaacagggttttgccatgttggccaggctggtcttgaactcttggcttcaggtgatccactcgccttggcttcccaaatactggaattacagacacgaggcactgcgcccggcctgatcggcttgattttaggctacaggttcttatggggcttctatgggttgtgacttcaatgttagttgagttttcaaagcgttggcagtgctatttggatctgtccaatattgccctcagactgggtggtggtctatattgtagtttagttcttagaatctaaatgtgctgtgtagggtcagtttcatccatgcacagcttagcgtgagccccagagtttataaacaatttagtgactacttccccatgtcctctttctatgtgatctctgcaatattttcaggttccctggggtcttcctttttgatcttttgatggaagggctgctgaggctttagttatctggctttctgtatactttctgtgattgtgttcacatctggggccaactggtagaagggcagagagagacaaaaagcaatagggtttggttttcattctctcaggaccataggttttttgggcagagaggaaaattctcctatctcctttaatctttttctggcttgcattgtcaccactgctactgccactactagatggcttggtgttggggcacaggaggagagaaaaagaaaggaagaaaggaaagaagaaagagaggaaggaagagagggaggaaggaatggagggagggagggagggagggaaaaacagtgatttcctccattttttctaagagttacctcgcattagttagttctactatgaggcttctcctggaggttttttgtccacatcttgatgatcccttccaggttctggctgcctcgaggtcaggctagaggataccagaagagaacaatggtaaattcactgctgatttggtggtatttctaattcgggtcttcttcaatctacctgccattgtttattctcaatgtcttcaaatagctgctccatgcattctgtccaggtcttagaacatcattcagtgggaaagacaggatgaactgtgataactccatcttacccagaaccagtaactcagatatctctttagccgccatatgctatgtttgccctgtacagccagaatggggagaatattgcctttaagtcagggtcatcagcatcatggctttttagcatattcaataatcattctctgtggggcaagtttcaggtagttcacctattttttttttaatcagagcctatgaatactataattcagcaaactgcattacagtggcatcctgtgcgtctcctggtagaacaatgtgaggtggccgtttcaacttcaaactcatttggctgatttagagaaacttaggggcacctgtaacatgacactgagatcaatttaggcagccatctgccatcttgaagaatggcatgcaataaaacgtttgaactgagtgtaatttttgtggtttttatcattaactgccacatgtatttcatggtaacgagtgatgcagtcccagtgattagggtttcatgttcggagaaatacaggggtcctgtcttgatggctgtactctgtatacactggaggatgggaagtggatgtaactaattaatatctatgaataagagtcatcacttcctctcttttttccataccctgtaagtagatagggtatctctgcccactgagaagtaacatatatctctgtgcccactgatgctggtgtgcagaagctctttgttgtcagtctggctgtggaagtctgtttattcctggcccccatacctgtggcattgctttttagggtgatggattctatcctttctcctttttctagactgggacaaataggtatagtttcttaagaagcttctgttgatttcttgttttggctaaaatttggcaatgagaaggacatttctatctgtggttgagtattttttttctctttctccttaaataggctagagaggcaagaacaactgaaagaggaatatttgattccccttcagaatgggattgggtattccagtctaactaggattcaattttgatcatctgaagatctcagatagtatttccctgctataagtacccatggaccactatattatccaaaattgctaccacagccctcacccttcctgttatccctggtttgtgaagtgtgaggggggttgtgcggctgtgcagtgggcagcaggatgggacagggcaaggattataagactctgattaggacgcgatttgctgtaagacctggggaaggctactgaacctctcttagctccctatttacctgctgtaaaaaaaatggaagagcttatggtatttttgaaagattatccgtatatgaaagcacctacccctcagtctataaattctctccttcaactttcttaagagatggaggtaggtgctgtttggctttctatttgtgatgagatttgagactgggtcagaactggatcactgatgggagaagatagaggaataatcctgatataaaaccaccctctaaggtggcataaaggcatccctacctacagtgcttacaattttgtgttgccaacacttttgtaaatgactgatgtcggggaaggtccctggagctctttgtggtgagatacggagtcagcagaattttctgactgaatacattttttagggcagcagcattgttcatcaacctaaatgacactggttttcccaaccccttcagcgtctctggcaattcaccctccactccctaaggctagatgattttgtctgcatggataggtgagaactaggtgcatctgtctggtttttcccagtcctctgcaacagtgaagatttgctgactattctttcccatatgttaatgaaaacccatccagcaagtgcagctttgcccagggagagctctgcactggtgttgactgcaaggagaacagctgtgtgctgcaatgagttacctcagtggatagacatgtattattgacttgaacttgctcatgggacaggtgagcatggggacagggaggggtctctttgcccaaacaggatcatagcaagtcctctccctctttccatcttataccaactgcagggtgatggcctgcctgtcagttttctggggatgctgaactacaatgagtggtaaaacattctagaaatgcaacaagaaatagaaaagtgtgcttcccagaactcttctcaggaggcagaaagtttgagattactttgaatactttaataaggtatttgggggaatactttgatacggtttttcggctaggagggatgagtctcctcctcccaaatggcatgttcaagtaatgacagatattttataacttgctttctaaaaagcatgggtctgcttgactgcaaaacttttcttttgctgagtatgcaaaattgggctcaagattgaattactagggtcagtagctgaagactctgaccagggatcattcctctctctatcaccccatctactgctctgcctgtcctccaaatacaagctggacaagtatttttaaaaagaatattttgaataagtacccttttttttttttttgcacactcatcctgtggaccaaggatatgctaggtatccattcaaaatcagtcgtggaggcaaggctggaagtgagtagcaaagccatttgataggaaggagaacgacaggtacgaatagtgtgtggggagtactaactgagagatgtgggcaagtgtcattctggtcatcagggtcctgtttgcccagggctcctttcagaaagccaggctgggtgatcctgcatcatgttaatggtgctacccacacatgatccattttctattttgggagaccatcatgtcccctcaaaatatcaacttctcccttatcatcatatctacccagagttaacttactggccgttaggaaagtccatgggtggcagagaggacctccagagaatattgctgtcttttggggacaaactcaggctgcttaatgtttctcttcaattcagagaaccactgtatgatcactgatgttccagccttttctagcagcagctaagcaataggaagccatgaatcacaggccccacatctaattggcatagttcctttgtctgagcagtagagctatcttgtctatcatcagcatcatcagcatcatcactatcactatcactcattacttataatgacagctgacatgtatagactgtctacaaggtacaaactcaataaatgccatctcttagtatggttagaacacatgctcatctgttgcatagaaagtactccacaaatgttagctatttgccaggcaccctgctaagcactttacatgcaccacctcatttcagctgcctccctaggaggtaggtactagtgttgctctcattttgcaggtgaagggaattaaggcttggagaggttatgctccttggctcaggagcacatgataaggctgggattttttgaagccagaggctgcgtgaacttaggcacttccctgctgtactcagtgagcactcaggatcatggtttcctcctcaaaggaaaactgctaagcccagctaaatacctcagcaatttataggctgcccactttcaatctctgaaccaaatgtctttttgatgaggcctaaaatccactctgagaaactgcagaggggaatttctgaaatcgcttctaacttcctgtgaaaatattctctaactgacaagagattgtccagataacaatgaatacacaataaagctggcgcttctgcctttgctaccaggctcacaaataacccatttggcttcccaatcactctgatacctaaaactagcagaatttatgcttgcggctggaatggctctgttcagccagaaagctaaagtttacgactgaaccctttgctctgaaatgaaatctagtctctttggcgcgactttattaggccatattgtatggcgataggagacataagtacccagaatctgctgtcactaaaacaggactgggttggcgagcgttttcgtcctcacactcaatactgtgtcctaaaatgggaaagttgaatagaaattagggatgcaaatcagggccattttctgaaactttatttttaattgaattcaatatagtcatgatattgcttctgtatctacacaacccacattccaatggagattcagctattactggggtcactgaatcaatggagagagactaagtagataaatctggacccctgaaatattgtttaggctaattatcacaacagcccaaacacttggatacccatcttgtgcttaattgtctaaaagctttctctgtaactggctccaatatctagcaatacttcatggaaagcattctttttcatctctggttcaaatcctttaggctgtaatcgattcttctgaatctcttgtcctcaaggcatcatggagaatacttgccccttattcttcaccgtctttgggaacagctccttgctactcaaaatgtgggccctataggggaagcatcagtgtcatctgcgagcttgttagaaatgcagactcatagacttgaccccacctcaggactaaggcatgagaaactggattttgccaagacacttgggtgacatacgtgcatatcaaagtatagatagcactggactccatatttcaaaggacttttactaagtaagccctcagacacatccactggtgagaccttgtcatttgctaacagcagtggctggtgggattctcaccaaactgtctaaaatagtaaagatccttcaaaggcacaggcaactctctagttttttgtgttatcaaaagcaagctccccattcctatgtggattcaaatgttctttctaactcccttcctcttctcccagttttttttttgtttttttgtttttttattttttttttttagaaaagatcaagttgttttggcctcaattttagaatttaggaataatgaacttgccaaatatcaccttccctgggctcagtctacttcctgttgaattgttgtttgactttactttggaatccaaaaaatgaagacaaggagaagacaaggagggctgagtcacatggggaagatagaataggcatgagatggggagggacggggcttcctctcccagaggaatgcaggcaggacttctagctagtaggaataactccagttagattggtggcaatatatcagttcttgagagttttgtctttcaaattcaagcctccaagttatcggatttagaatttagaaaaccgtaagtcagttgctaagaagcccaagatgttctgtaatgaaaaatttcccagaaaatattgctcatagtaagaagttttttgggaagtgtaaaaatgacccagttatacatactccctggtagatcctaacagtgcagaaattttttccatgctcagaagcagaattgatttatttcatgccccaacactaaacgctatgaagttattgaagttattcatgcttacttatgatcagatgcctagaaaaattgttcttgtttctttaggcctctctctccagttttatcttgcttagttcaactcagcagatattaacccagcacctcttatttgcaaagtactgtgctgctccttctagaagatacagagctgagtaagacagctcttcctttaaggagcttacagtcgatacggaaatggaattccacctcattgtagttctcttcagatgtcagagaagtcaaatgctgtgatggtacttaatgctaatcaccacacatggagcacttactaagtaccaggtactgttctagacattctgtactgatcatctcattcagcccacatggcctcctgagagatgtgtgcagttactattcccattaaggcagggacagcacagcacattggtgaaatgaggaaaggcctcagagaggaggtagtttatgacttgaaagttacaggaagcactggattttgacaactgaaaaaggtcatagagagacatatttgtgatagaagcgtcaagggaaacagagatttcagggtgggaagtcaggagaggaagtttttagattagcatttcccatcttcttaagctgctccttgaaataaaggattctgtgactaaatatcatgttctggccgggcgcggtggctcacgtctgtaatctcagcactttgggaggccgaggcgggtggatctccaggtcaggagatcgagaccatcttggctaacacagtgaaaccccatctctactaaaaatacaaaaacaaaattaaccgggcgtggtggcaggcgcttgtagtcccagctagtcaggaggctgaggtgggagaatggcatgaacccgcgagggggagcttgcagtgagccaagattgcaccactgcactccagcctgggtgacagagcgagactccatctcaaaaaaacaaaaaagtcatgttctcctcttggagatttacaattcctcttaacatgttaaatactctaaggagtattgtgctgaaagtaaaataataaaattaaataaaacaagttggctttgttaaattctgtgcttcccaagtttatttcattcattcagaaactattattgagctatgactatgtaccacgcacagttccaggcagtggagattcaggtaaaaatctgtgccttcaacatttcccacattctagtaggggccaccacagaatcccctccccattctcctttgtttcagataacacctgctattaagttttgtcaagttctttctgtgaagtattagttgagaataattctgcttttctgaagcaggggaaattatgggaagtcagatttttaagacagagtggtgccatgttgtggaccagcacaattccaagtgtggtccatggtccatagatggggactgtgagctgtttgatactcatccgtgacgagttaagtacagaagatgagagtaagtgcttagaaactttcaaagcaattggatggattaattttatatggattgtgaatctatgataaaaattttggatttgtaccttgcattggatttgtcttttcatttttttgtaattcttatttatttatttatttatttatttatttatttatttatttattgtctcatcatgttgtccagacaggtctagtactcctgggctcaaacgatcctcctgccttggcctctcaaattgctgggattacaggcgtgagccagtgcctggcctgtaattcatttttattagattttgcaaaagaatggatattagaaataaaagctaaaccctggtccctcacctcagatggggtaagaagggctgtcctgaaaaccctgcatacgaagctgaactattctggggttggtttggcagacgtctgactgaaaacatttacttcctgctcaatttacccaaataagaattattttcagtggtatttttaagaatccttattatttgaaggacatgtaaatatgttctttactattagcaaggttgcaaaaccaaattcctctctgaacagagagtgaataggccaatctttaaaaaaggctcttaagtgtaaacaccttttctatattggagagaaaattgaggatagggtggcaaaaccttctatgtgttaaaaaaaaaaaaaaaagaccagtttcctgccacatatgtaacactttaaaaaataatttctcaattattattttaaaaagttctcatatcactcttgctgtttacccttcctttaccttcagttcctctggcactctgtctttccagaaataaacctggttgggataatggagtgagggaaaataccatgtattctggtacttttacatgtggtgtagtcttttaatcgccctctgaacacctcgtgtgggttgattctttttcataatgcctgatggaagaaatctcatttgatagtctgcagcccactggtctgggagtaagagatttggctcaagtccattccgaaattaatatttggagttgtttatttatttgttcatggctgaagcaaccagttttctggcattccatcaaatccccccaaaattgttttaattgacattgtcctgaagcctttggaaaaatctgagatctttttgtcctagtcacacattctggaaaatgctctctgaaagaggccataattgtggaatgccaaattgttatggagtccctgaaatccaagcaactttcagaaaggcagctgaactgagtccacatccaagaagttcagcgctgagatgcagtttggcacagagaagaaatacattctgaaaaggtgcaaatcactattctcttctgctttcttcctttggcttcaacttgatcactagttaactccaccccagaaagctgtgcagtgaggcattctctgtgctggcaccatttggacctcagctaacaagactcaaacatttcattttgtttattctatgaattgcttttaggatttgcaattatactgaagaacgaagaggctaagaaggggtagagaaggagataaccacatgccctttgataaaaactggggcaagtttgttgacattggaacatagagggaaatagaggaggagagaatctgacaagtcccatgatgaagtcttcttaataccttgctggccttaacatcgtacttttcagcaagaaatgagaaaacgcaagattcaattaaacttttccccttgacagagcatgctgttgaggaatggatacaaatgaccccccatccattttagtaaccagcccaaacattcatcaacttagagcccatcaattctgatttcatgtttagtattgtaggcaaggacttgacacattttgtggggttttcttggggggtgtggggtcatgataaatacgttttaatggcatctaagatatgccagtcagttcatatgactgcattctgtttcagacaatcttattataaaggacagtgacaatgtattgcataattgatatatataaatattcattcaaatgtctctaattcttattaagcacttctaagatttaaaactgtggatcctttataggaagaatatttactgaaaattcagatagactttttaaaaatagtaaatgtagtaagttcttgtgaatacactaaccttctactacctgttttgggcagtgttagtgtgtatatgttacgactcatctcttcttattgcagctattaacataatggtcattggtttttataatttccttttagtgctttatttttgatgtgcataatataatgtatatttggattaaaagaatttgcctgttttcaattaaataaggactagtatatgacaatctttggaattatttacatgacttcacgggtagaggtggacttttgcaagattatttggctgtaatcaacacagttattcagactttttactgggaacagaaatcatgatggctgtaacatactcccagccaggagagttgaatttttcacattcactgggctgttagcattagagaaacacagtttcactctaatcagaggaagcataaaaaataaaaggcatcattaccaacccaccattagtgacacacacagaacctgggatcaggaaggtgtgacttcccgtggagccaaggctgaggtttccagttggaaggtacatttgatgggggagctgtctgcccgtggattggtgtgaaaccatttgcttgggaggttcaactagactggatgaaaaattagataatgaagagtagataaataagacagtaaatgagaggtgtaggcaagctagttcattggctcagtcccctgttctcactgatgatcccgtgtgtatttgatgaataaggacccacagagcatcatctgctcatctttgctaggcgctcttctaaaacagctggggtttgatgtgacagccaaaggataaattgctgcctcaggaaatgctctgcctttgactgattgctgaatggctggcaaattaattctggcacctttccctaagtcattttggtcccattccttcatttttttctgctgagaagtgtgtcttcacattacagttaaaaatacattgacaacacaaatgtggggaacagcatgtactattttaggaaagaagttgtaggctaggaagtttccattttgtataatagaaaccatacttttatgctctgagaggaggcttgaaccgccctttcagctagagccaaaatggattattactccttgctagacgtctcgtaaagtcataggctacagagtttgggcttttgagtccttgatgggcttcggttttgatatttccctctttggtacttgtacacagcaaatcctccccattccccgaaatcctaacaccacaacctccctacacctctatctttgtggtgggtggttaagagtgtgaactctgaatcctgtttgtaccacggattcactttgtgactgtcagcaggtttcttaacctctctgtgcctcagttttatcatctataaaaggggaattcataatgacaataactccctttacctggtccagatttctttgttcactttcattttcttagtattaaacacaaggttttatttatttattttagagacaggatctctctctgttgcccatgctggagtgcagtggcgcagtcatagctcactgcagccttgaactcctgtgctcaagctatcctcctgcctcagcctcctgagtagctggcactacaggggtgtgctaccacacttggcaaattttttaattttttgtagagacagggtcttgctgtgttgcccaggctggtctcaaatatctagcctcaaacttcctgcctcagcttccaaagtgctgggatacaggtgtggctaaggatttaaattcaatgtattttacactgttttttttttctgtcctaagaatgcattgtatgagaaatgtacacttttgtttttgcttttccaaagtaagtcaaagataccacactcgagacttagaaaagttaccttgatagaaggtgataatttcagcccttgggtaggtataaagactgaagttctgttgctgagtttgtgatgcactatgatgtaatgactctgggttctcactcctgacttgtctgatgtgattggcctattcgtgtccttgttctggcatgacttaaggattaaatggtctcagtattaattataattactgattctcctgctcttatgttatacataagggttttaaaaatctttttaattgtgataaaatacacatacaaaatttactatcttaatcatttttaagcatgtagttcagtggaacattcacatgactgtgtgaccatcactaccatccacttccggaactctttttatcttgcaaaacggacactgtctcagttaaacgatgactcctcattccctctccctgcaacccctggcagccaccttcctactttctgtttctatgcatttgaggactctaggtacctcatataagtggaatcataacacggttgtccttttttgattgggttatttcaattagcgtaatgccttcaagggtcatccatgttgtagcatgtgtcagagttttcttcttttttaagactgaataatattccattgtaaattaccacactttgtttatctagtcatctgtccatggacacttggggtgcttccacctcttagatattatgactaatgctgctgtgagcatgagtgtacaaatatctctttgagatccttcttccagttcctttggatatatgcctagaagtggaattatgaatccaatggtaattctatgtttaattttttgaggaaccaccatactgttttccacagtggctgtgccactttacattcccaccaactacatacattgcttgagaatatgacagtgtaattcaattagcaattttagactctttttaaagtgaaattcctttaccagaaacctcaaaaacatattgactatccatatggaaatagtgttaaagatgtggaaatcttaaacagatggcaatggcaacggatttaaatgctccagcatttattcagttgattcgatgctactaggtctagtgtgtagagactatccgcaggtctacacaaggatgtggaagaggcattttgttttctagaacattctgtacttttttccagttatacgactttcagtcctcaagcattttgattagccacagaggcaaacttgcaggaaaaaagatatggaaaaatcagtaaaagtcagatatatgtggtcaggtatatcatagtcagatacatctggtgctttctctagcaaagagaaaaatatggggaagtaaataccagttttgatttaatcagaagctagaacagatcctaagattaaaaatatatgcagtcaatatttgctgaatgaatgactcaataaaacaatttttgctaaattcaaaacaaacatgaataatattgttatcctacaaaaaatgtgttccttcttatttaaaaagtttagtgattcacctacaataaaatttggtataaagaatagcttcattaggacataaaggcatgaaaattctgaccaaaactaaaagaaccttgttaaaaccatattaattgaggaataccaccaatgatcaataataaaggtttgtattttcattatttttgataatcagttgttgtatttaaattagaccataaacaacacattataaaagaacacatatgaaaagaataggctgaattattttacttcaggaatactatttgcccataaggctctagtatggggatttgtaattagtgatacctcatatagtatcctattcattaataaaacaaattatgttaatactgtttcccaaatattctatattccaacatttttttactaaggcagattaggctttcttcaaattagttagagttagtgacctttgcttataagtcaagcatatcttttattcgaaaaaaattattgagatcttatggtttggagaaattaaaaagttcaggcttagctaaacacattgcagttaatttttaaaatcataccatttagcaatagaattggttgagtgacttttttttttaaagaccccactctggggaaggccaatttgtagataaactgctcatacccagcagcactgcctagctaatgtctaacctgtgggagtaggctggaagcagctcaaactaatgaggttaacctacataatctaatcgcccagactgagctaaaagcagacaaagagcacagagccagggagccttcagtttatttctaaattttttctggcttttgtatgctggagtgtcaccaagtagatggtaggtgtgcccttgcccactgttcctagctctccttctggtccacatgttgcatttctcccagtgaactgactgactggctgccagcaagatgccttttaatacaagataagcacaagccgttctaaagagccacttcctgttggcggggtggcttcctctcatcttcctcttacccatgcccccactggaagggaagcctgagaggctgcagccaaagacacacagcttgccctccttccctcagggaggcctgtgagatccctaagctcccatagcggctcaacgttctccttgtaattcaccagtttctaaagactgactccattgtaagccggtagcagtggctcatgcctgtattttgggagcattttgggaggccgaggcaggcagatcacttgaggtcaggagtttgagatcagtctggccaacatggtgaaaccctgtctctaccaaaaatacaagaattagccaggcatggtggtgcacacctgcaattccagctactcaggaggctgaggcaatagaatctcttgaacccagggggcagagattgcagtgagctgagatcccaccactgcactccagcctgggtgacagagcaagactgtctcaaaaaaacaaaaaagaagattcactacattgtgaaatcctttcagagatgcctagcatgaagagggttgctgggaaaaccagctaaacttgactacttagaaaaaatgcatattttaatgaaatttggagcaagacctctctgaaactacattttacttttgtgatactccttttgaaatttggagcaagacatctctgaaactaacattttaccttttgtgatattccttggggggtcagaaaaatctgtcattttgtgcaaagtagaaatatactgtttcattataatatatacatgcttattataaaagccttcagacaatacaggaatctatagaggaaaaaaagtatcattctaccactcagaggtaacaactgttagtgttttgatataaagcttcctaaattctttttatggctttacaaacattcagataactataggccatctaaaaaaataggatcagattatgtacactattttataatgtgcctttttacagaatttctgtatgaacaggtatacattttcattataatttttaattgcttcttagtattccattgtatgtgtgccatttacggttatttcccatttttcatgaatagaaaggatgttcttgtatatttttttacctctgttttcctgtttctttgctatgaatacttcaaatggaattgtagtgtaaaagactgtgtacttttacaaattttgataataattgcaaaattgctcttcaaaacagttgtatcaatttccttgcccactaatgtgggtgagtgcccatgtctccgcaccattagaagtcatacagattaaagactgtgcacggtggctcacacctgtaatcccaggactttgagaggcagcagcaggaggatcacttgaggccgggagttcaagacaagcctgggcaacatagcaagactctgtctcttaaaaaaaaaaaaattgccaggtgtggtgatgcacacctatagtcccagctactccagaggctgaggcaggaggattgcttcagtgcaggtgtccaaggcttcagtgagctatgacccactgcactccagcccaggcaacagtaagaccctgtctcaaaaaaaaaaaaaaaaaaaaaaaaagaaaaagaaaaaagaaaaaggaaagaaatcacacaggttaaaaaagtgttttagagggcacacactttatgagtttagggttattgaaggctttatatgggtgcagaggccgtgttcctgattgctgaaaaggtcaccattatctaaccagtgcattcatttgtttgcctaagagtgtaactcaggtttcccttttacagcccaccgtcatattttaaactctccgcatgtgttcctttcctttagattgaggaagacacatggcagaaatactacttggaaggagtctcaaatgaaatgtacacagaatatctctccagtgccttcgtgggtctgtccttccctactgtttgtgagtaagtgacctttaactggatgctctttggctttcagggatattgaatgtgccccttgcaaggaagcctcccacctctgctgggtacagttggagcacttgacaattgccgagggtatcccgtgtgctcggccccatgtgatgaataggagggtgggtcattacatggcctctgcctggggaatttccactggccccacttttcttgacaggcctgagagtcttggacttgaattcatcatttatgctaacttatgaactacagttatcctgcatgccttctgtgatgtagacacatttatgaagagtggcataaacccctgcctgtctgattctaagagggcaaaacaaatcttgccagcccctcaatgaaaggaattttaatctgtcttcccatcaagtctgatcatagagacaacagagaagctactgaaataaagccattcaaagtgttttcaccctttgctgaggaaatgtggaaccaaatatacagaaggaggccttgagcccccacatagacaactgccatgttataataataacaagtcttagcttctctttccactggctcagcaggatggatcaaagccacccgccatggccactgcaggtagaatagatggtcacctatgggggatgacctcaagagctccaggtgtctgccgtgaggcatgacagtgcctcagattcctcacttagaatcctcatgtctgcaatcccaccacttttagaagctgaggtgagaggatcacttgaggctaggcattcaagactagcctgggcaacacagtgagactttatctctacaaaaaataaggaaaattagccgagtgtggtggcacacacgtatggtcctagctactctagaggctggggtagaaggattgcttgagcccaggaggttgaggctgcccaggaggttgattacgcaactgcattccagcctggatagcagtgattgtatctctaaaataataataataaaaaatctcagatgttgagtttaagatgaacggggtctttgtgccctctgaaaacacaaactccctgaggttggtgaaacattaagcctattctcctgacaccttagcaaaggatttgacaaggattcttctcactgggaagaaacaggggtatctgggagctcactgggctgaggaagaaaagccatttgcttgcacttcctgcctacatacaaaccaaaagagaggtctgaagacatcgaaacaaaactgatcaggctttaccacaaaggaggggacagtcctgggtgcccttggcctcctctgtatcacggttttctttctgtatgcaggagggagggaggcggagcgcttggtggcttcgtgtttacctggagcctcctgtcactgaacacagcaggtgcactctgtcagtccctgggcccagaccctaagcaatccaaaatggtttggctgtttactgaaatttctcaccctgtctctaagcgaaagttttaatgctaaatggactggaaaagtgaataggtaattgattcggaaggagttattttctgaaaatggatgccctattgtgactcccatgtgtgcctttctttgagagctatttctcttcctgccactgagaggagttaaccattcagaggcattgggtcctggaacactgaggctgtcccaggggatctccccctccctggagcttggtctgcctaggatacaaagccccgggggaaagcaggctttttaacagaagctagttttataaaaaggcaattgaagccttggctgtctaatgtggtggtggtctgagcacatagcagagctgccagcgcctgcgggagtcttatgttggtgagggtgtcagcaggggctccgtcaagcccccttccttggctgtagggtttccctggcctaactggtgtttgtatctaacaagagtgctccctccccaacccccaggcccttcttgcttttccacccttctcttactctgctcttgggaactgagtccgttcctcttatgggtaacttgaagggtcaggactgctccccctacaggctctaactgggatagtcactaggtatgtttgactcacgtaggtatcaactagttgctgatatttccaaatagtagtatgtcacgtaaaaactagatttctggattctttagaaaatctaatgtgacaatgcaagacctgcatttcctcggaatgctaactggctccagtttgatgtagcaaaggggttagtatagtcatgtagttactcctccctgatatcttaaaccaggccagatttgcacataaatcccaggcctggccctgtggttgtgtgagtttgccaaccctgacccactgggtggtgtggaacttcactggccttcagccagctcaagagctggcactagtggctctgtgaatattccctttgattgatttttgtatttagaacatgtcccaagaaggagacaaattgttgtcagataatttagtatttgctcagtaaagtttctggaatatatatatattccacttctgatgtgagtgagaatgtgtacaacttagtgctattattcgtttaatacaatgatacagcagaggtagaaatgatcaataaaagaaggacatttaatgagatttaggaacatcccaaaacattgaagctctcctcaagcatttgattatctggaggcttaattatctgtgttttctactttaaattaaagaaaagccataactcaaagttaccagcagtttaatgataacactcttcaattcaggttaattaaagcacagccgtaattagagtgtagtgttgtatatcactgggctggcacataagtattttcattacagtaagaattggctattcaatttcaaaatgacataaaggatgccaaaatatattttaagctggttcacgaagaagaaaaagaattggggaatattctgggtatcataaagcacagataaaatatacagattttcagagcagtttctgtaattatgcgctgcgctaaaacaatatgcagccaataacatcttaaagcatggaaagaaataaatgtgctttttctctaggctggcaaaatgctcccttgcagggtgggattgggagagcttggagttttctcagaagctaggggagtcattctatgaaaagatatgggagcaggatgtaggggtgaaatttgagattgtttcccaagagaacaggaaggagagcaaaagaggcagtgggggcagaaggtcctgccaccccgaaagctatctctatcaatttcaagccaagagattctcagtgtagccttcagtctgtggccaaaggcccaagagcccctggcaaatcactggtgtaagtccaagagtccaaaagctgaggaacttggagtgtgatgttcaagggcaggaagcatccagcgcaggagaaagatgaaggctggaagacttcacaagtctagtccttccactttcttctgcctgcattatcctagccatgctggccgctgattagattgtgcccatccagagtgagggtggatctacttctcccagtccacagactcaaatgttaatctcctttggtaacaccctcacagatacacccaggaacaatactttgtatccttcagtccaatcaagttgacactcaatattaaccatcacagatgcttactccaatctccttctctgaaataggagtgctatgacttatctgtcagtacgggttaatgtcttttcccctctccctcctctccttttccttctacctttatctttctcattgaatataatagaagcacttagaaagaaagaaacacattgcgagctatatgtgtatcccagttatatttacttttaacctttaggaaattctcttatcggttaatcaccgattaatcagatatttaatgaattgggatatgtgcaccattgtgccaagcttggtgccacttctagaggaaactgctactagatttgatcaaatatatgtgcatgaaaagattaatagcaatacttacaaatgccaacaaatgccaagtaaaatattcagtttccctagggtggctgcctccagagtttactgtctggctaagggaaatagtacccatcgtcagagagatctagacacccactgataagtgctgtggtagatgcacacagctggaatagagatgctgagagttatagggacatctccctgtaggctggggggacatgggggttcttcctggaagagatgacatttgagctgtgtcttgtcgggagttttgattcagatgggggataaagaaggaagaggacattctaagtggtagggaatctggaggctgcgccacctggtaccatagggagctctctcaacacctaggtctccgagattttccagttacagcaaattgctttcctctttagatgagacaaagagatgcatcagatttattttgacttgtgatttttttgggggaaactgataacagtgtttttggtgagcacttgcgaaagcgagggtgcactcccctacccccagggagggcagaggggaggggaggggctggacaaggaggagctgcaggaaaccatgggttcagcagttgggctgcctcaagaacactgtgttctaggttctgaatctcaccgggaacctattagtcagtcattcatcatttgcaaaatataaaagcttaattgtatcaggttttacagctcagaggggattaggacaaaagatgtatttaaaatatggtatgtgtctctctctgtccctctgcagctgatggagcagttaaaattcaggtttgatgtggagtatttaatgcctggggaacttggggaactccaatcagatcttcctcagctgtgctgaagggcaggagttctgtccccaagcccaggggcaagtatggatgctactgtgctggtttaagagtgcagggggattctcttttccctcctctacctccctgcattcagtgctcccctcctaaattcagaaaatcatgctctcaacctgtgttattttgcacagacagatctttaaaaagaagccgcttggggaaatttaaaatttaagaccgcccggcgaaagctgggcctcttgcccagtgaaaactgtagctagtttaacttcagttctgtgaaatcattagtttttggagaaagacatccaaatttgaacatggagcagaaaccaggcagacccaattgttatatgatagatttctttagcctggctgcaaaaatgagcattttaagtgaatttatggagaggctcagatctctctctttttttttttttttttttgagatggagtctcactctgtagcccaagctcgagtgcagtggtgtgatcttagctcacggcaaccttgtcctctggggctcaagagattctcctgcctcagcctcccaagtagctgggactagagacgtgtgccaccacaaccggttaatttttttgtatttttagtagatacggggtttcaccatgttgccctgggtggtcttgaactcctgagctcaggcgatccacccaccttggcctcccaaagtgctgggattacaggcgtgagccaccgcacctggcagatctcattttttaaaaaatattttcccctcacagaactggctctattcatccacttgattggggagtattgtaattagggttgaacatatatgaatagagatgtgaatacagtattggtggttatttctactacagagacccaagaggtgaccttctatgagctagtgaataaaccgttgaccctaaagtctattgaaatcctcaataacaggctactgaggcagtggtgggtccagaattctctacagaagggtcagggaaggagtcctgttggaaatggggtggacgcttgggctttgactcaacactgggttcttgtagcaaacacatggttttttctttcatattatgtttctcattaataataatagcaaggctctctaaaaatgcagttgttcacactttaggcaaaagttaattgtctgtatcaagtaatgtatttataaattctagtgtcttaggtgtgctagtggagattgtgtgtgtgtgagtgtgtttgtgtgtgtgtgtgaaagagagagagagaaggagagaataagagagtgggagagagggtggggatattctgaaaccttcccactccactcctatcaaagcttcatagagaaaaagagtcttaacatttccatgaacattttaaatcacttctcttttcttggtgctgagtcttggaaatccggatgtttcaaagtttctttacctggatatttcgatttctagcggctgtcattttaaattaaagctcctgaatgtgaatcttttccattccagcccctcgatccagaagaccttgtttcccaatgtgcagtgtttgtatccgtatctacttcaattgcatgtgccaacctgacattcccaggggccctctggatagctgaagaggggctggtgctttgggtggggttgggttcagggggaatgatgacagttgcttctttcatcctccctcacctgacttgtggggtgagtcctcttcaacagccccaaacctcctctttgtattttcttcctgaaggtgcaaactctatgacaggtttccatgtttaattcacaccagcaagtaatgtttccagtaaagggggctgatttaatggcaggaacaatgtatttccctctgggtaggcagaaacagttggactctaattcttaagagcctttgttcaggaacatctgggttgaaactactgtagttaacagatgatgttggcagtaaaaaaaaaaaaagggggttgggctttgtataatgtcgttgtcaaatttggtagacctttacctaataattatcaagaaagcaatctaacttgttattataacagttttattgcagattgctggcttaagacctttttgtgacaagtggcattttttttcttgaaaaaagaagtcatttctattcccctgtaattatttttgcaaccagcaacaacttcctgcgttggacatactggggcattttattttagaaaccaataattaaattattgctagcttatggctgattttatcccatttatcacattgtgaaggctttcttacttccttttttccccttacctcacctcaccctgcttcctgatttcacaccaattctgtatatgttgaaacactgtaagttgagtaaaggcagaattagaataaggattagatggctaatgctcattcttctttaccaaaaaatggtgttgagtgatgcaagtaaatgtttaaccagagaacatcagttctgggtatactgaaagtatatatattcttgggagtgtaaggggtacataagggtataagagggtctctagaaggtcccaaggacaaattgttgtatcttagaattggacttgcatcttggcattgtggattgaaggcaaaaattagattcccagagcatatcactacttttatttccttctgtatccttcctttcccatctgtctgcttctaacaaataagacaagctaagaagcagcttgtttcatgattctatactcacttccaagctttctctgcatagactttcctagtttgccactttatcttttctccatccctccagccagtcatgagattctactccccattcatacatgcatttatttatccagactttactgaaggcttactctttgaactttgcaaaatgccagtgaggcaaagcatgcatcctgtacaggaaaaactcagtctagaggggagagataagcaaacaagtgattaccacaccagctcccctgttcattcaccttgctctgctcttccccaatggacacctccaacagaggctgcatctctgcaacaggatgcagtccttaagcccaggattgtgacattggccaactctctgtggcaggatctaacagaaacgtgtgatttgaacactcacagagggagccatagctcttgcttccagtgtaaatcatggtgtattatacttgatttgtattttgcaatatctagaggatacctattatagtagggattaaaaacttagatacctatagggttcaggcagttagcaagaaagaatgaagagtgaggccatctgagacaatagagagtggtgggaactgtggcacattggagaacaaacatcccatccagagggataagtgcttcacagctgcactcccttttagcatgtggaatgtggtgccaatgtggccctatctgattttgcaaggaaagctgaaaagccagtttctatgtgaattcacttgttggcatctatttacagttttttaaaaaacactgtacttaccaaacagaatgtgtctgcctgttgggcttgtgactgccacttcatttcctctcttctgatgagaagcatctgtgcagcacattgcgtcaaagactcgatttccacttttggctttttacataaaagtcaattgaccttgacctagttgctctcctctgtttgggctcagtttgttatctgcataggaagggcaagatcagccaatcttgaagggcttgagtctgaaaatctgtgttgtggcacggcttgcctatgttctctctgttcacatcattctatccctctcctttcctttggccagtgggccacagcttgttttgggtcaaaggactttttaaaaggggcttctataaggcattgtagaatcagcttgggtatggatttgaatgttttgaagttatggatttaaaactggaagaggactcagatctgcgggtccatcccctataaggttaaggaatgaatacaaggccacatagaccttaggactttcttgtagaggaaactcttttctttttatatccagttggtagatggtactgtagtagctaggaagacataattcaccattactacgaactgttacttcccttcttaccagcgggattaggtttataaaagcaatgaagatctttgatcccatgaactaccagagtcccaaagtggactggtcattgctcataggatattagcaaattaacctttgcacgatccatactaagtttaagatcagccttctccctgatgtttttgtatttagctactatttacattagaaagtggttacttaatttggtaatttggttcaataaacattgcataagctatcttattttttaaaaaaacaatttaagctccagaagtaacagtcccataaagggtgcatgttagcagtgctctttgggacataaattaaggatggcattttccagctgtagttggatatgtgtgttggtgtttcagcaagctgcataatcagcacaaagcccaggtcattagattctgctggcaggaatcagaaaacctgcaaatcaccaggagatcccagatatgcctggatagaagtggtcctttgacatctgactgtctgctgaaggcagtgctgtggaccacaacctcacatgtaggaatgagcaattggtttcactccctggagagcatgaggccttcagcagcactttccttgaaagcaacacatccccctatccagcacatctgattatgtcacttttctcttttaaaccaactaaaatcccccaattccacttataataagctgtagactccttgctctggaaagcaaagacctcatgatcttgctcccccctcatttcctgacctaatcactgtcacgcttgactttgctcactcagctgcagtcttactgaatttattgctgatcctcaaacacccagagctcttccctgcctcagggcctctgtgcttgctgtttctacttcctagaaagctctttccccatatcttctcatcatgctgttgtgctccctgcatcctcagaatggtcctcctgaaccatcacagatgatataccccttctgagttactctttatattcttaggttgttttattttcaacatagaacttgtcatcatctaggaatttattgtttattcacttgtatattttcttattgtctgtctctcccaatacaaaataggcttcactggagatcaagatgtagggtatcctgccaggtattagctagagaccttaggcatgttacatggactttctgatccttggtttcatcacgtgtaaaatggagctatcaatagaagtctgaataattggggtaatagcttcctcttagggatattgaggggattaaattgacccacaaggaagccttccccacactgtgacccagtatcttatcccccttacaatgctggagctaaataaataagcatcaactcattgttcagtctatcagttaatcaatattctattattcaaaatggtaatgctaattgtagacacttgtcatacatcatgtatgtaattattttgtttatgtgagcttttattctgtaagtatgtaagtgtataggttcatctaactgtattgtgccatttacatattcatgtatttttatatatttgttctatttacatgttcatgtctttttatatgatattatttattgatcttatatcttgaaatattctttgaaaagccatttagaatgctagtaccatattgcactgtactttatggccttattattggacatttaggttgttttctatttttctactccatataaataacacttactctgaaaatctttaagcataaacattttactgcaccttttgttattttcttagacttgaaacccagtaagtggaaaccatttgtttgtttagcttctctgtatcggtgggtctattcactatgcactatggagaattccaaacaagtccaggactcttaaggaagttgctctggttaaggagacaaagttcagacacatgaaacaatagggagcgaccacagccagtgtaaaattgactaaaggctcagtgatttggttacagacaaggtgctgggagagttttgagaatagaaaatcacagggtagcagtagctggagaagacccactgcttgcaagattagagttgacgtggcctgtgaggatgggttgggaagagagaagaagggatcgagagtggggaacgcacaagggaagggatggaaacaggaacaagccagcctcaaagcagtctgctctgcagtcgagagcaccaagcagatgaggtgagacagcttggatggagccaggagtgacaatgccatcgtcatgtgctgggcacttacacagaggccaagtattattaccatcattgcaagcacacaggggtctgctcggaacaacaatatgagccatttgtacaaaagaccgaaacggaatccaaataacaggtccagctggtccaaatctttccctccccctgtagttaacattttactacccgaccgagtaactaatgaatctggcccagagtaaatccccaggcacaaattcctgcttgggctctgtgtctagacagccagccctgagtgcaatttgcactttgagcatccagcaccttatcacttgcaagaaatcaggtttaatagggaagatggggaggtgttgcttccaccccctccctttggcacagtgccggtggaatgaggatcccctcggtaatgactgcattaggagaccgaaagatcgtaatagtgtgtgttatgtggctctggtcattcagaagaactgattgggaggcttctccatctcattgcaggctgtgttttgtgaagctcaagctcctaatgatagccattgagtacaagtctgccaaccgagagagccggtaagtttgcggtgacccagcagccagctgacacttttgatggtgagagtgcgttctgagaacggtcggttcacttctgctttcttgtgcattatttatctgcatggaaccagatgtaaaacctctctgaccctagagcacatttcgaggcatgccccatcagacactgcagcttctatgccagaccagcctggcacccaaagccctgctgggcattcagagagtgtttctccagggaagagggatgagtcctcaaaatatctccacctgatcatgccgacctggacttttcaccttctaagtattaaaccagaacttaaaacccctttttactgctgtgagcaaaaaagcaggtggactctggcctcctttacagcagccttggggtagagctgtgaggggagacaccaactctcttgatagccaaattacaagcagcctattgtgtaccatatgtgcttctcccggtgcaaccaaaatccaggtggcagaatatcagcttcatgtaaatgagccaggagagtggagctcagaggcaggagctctctttatttatttattttacacttaattatgtgcaaatcagactgatgagggactgggtctggttgaaatagataacatcccagtcaatatgtgagttcacactggaggtgggaagcatcgtgctaacaagaaattttgctgatggagtactgtacaccttacagataaaatagagatgatttttttgctccccagttcttgtcaatagttttggaagaaagagagctcattgagaaatgctcaagcttttgttctctgaaatgacacccacagtctattcctctatagttcatatttttgatcctgcagatgcccaaatgtagagtgcagatcccctccaacaaacaccttaataactgagcagagtacaggggaagactagacgtttccttttatcatcatttaaggagttttccttatctgggtgaataacccaatacagccagactttcaagtgtatagtctgtgtctatgacaagacaaaacaaaagaaaagaaaacactggattgtaaacagatcaatccaatgttttctgttaccttaactaccagatcagattgctcacaaagtcaatctgatcaaatgttaagctattttgaaaacccaaatcaaccaaaaggaagaaaaaaatggtagatttggtggccatatgtagaacatggctgtagcagttaacaaatatgtagatagataaatattttctttttcatgttggcaaagtgaagaatattgtttgcaaaaactgacagtcctgattattagttgttcagcagatgaggtggaattttctggggttactgtttacccatgtttttgccaatactcacttgtacctgtgtaggggaactgtatgtatcctggatttttgcaaatgatattccccgtgttgcgaaatcgcaaatctttgtgtaactcagtgttctctatttacttttgtgcatctttcaaaaaaaaatgtcatgatgtgggtgatgctgatgctgcatagtgtttttcgaccattctggaataatctgactgcaggagattgcaccctgaaccttgagcagttgtctttcacttgttgccttttggttccaaggagagaaaaagagcgaaaggctgttaatggttcattgtgaactcaatgtcactattctaagaaaactaactcagagcactccctgaagatgaaacttttcttggataggcccttcaattgagtcacaattctgagatgttttcaacaaagccatatttgtagatatagtttttagtatatatatatatatatatattttttttttcttcagaaaagggcaaaaaggacttgtttggctttgtttgggctttctttgtgcagttgccagctttaattctcaaatgtggcttggtctcagtgtggaagcacattggttcttgtggaaaaaggtgtgtttgagggaatgtggatcatgcctctgagaaaacacaggacttatcaaacacaatatccacgtgaaaacacacattttttaaaatcttccctgagataataattttaatgtttttctttatttaaacatgtcccacttctttccctctcacattttctaactgactgggtgtgaaaattcaaaggacctgtttctccttcccaccttctttaacctgtgtttaactgcctttgttgttggtttcaccccatgatactgttttcatgctttgccaaaaaaccttgttttcacatgcatccttcaagtgatttgaaacaaaggttttattccttctttccttctggtgtcagtcgatttattatcaaattgtttgattttaaattcttttcttgtcgttttgcagaagccgaaagcggtatgcactcttcgttaacttttcttccaacctccaccctctatcttcactcctaaccacaggactaaccatttgccaagaattcaagaagagagagattatatatatgtatatataatctcattcccttgtctggtgtatctatattatatatgtgtggtgatatattttatatatatatatatatatatatatatatacacacacacatataaattatatataataattaaatatataannnnnnnnnnnnnnnnnnnnggggtatcagtacgtggaagagagttgtgagatattgtcacatttatgcagtccgatagaagggtagatgctgttggttttcacgagtcagatagtcgtgtcgttccaatgaagagatacttagcttgcatccatgcatcgagtacgcgatgctgcctcgatggaatcaggcatctagtgaaaggtggtgcgtaataattggtattagatatagtgtgattgatgcgtatgtaaatgaagattgtatggtaggtgtggggaggggggggttgataagtggggttagatgagggtggtaagggggtatgaagttggtgagagtggggtgggtggtataagattaaagtgtggtggtttaatgattataggtggaatgtgtaatgcaatgatattaagttataattgtgtagaaaatggtagagtttaagtgtgtttagtgtgataataggatggaggaggaaggtataggaggatgttgttgatatggtggagggggaaattgaggtagtggagatgagaggaaggtggtgagtatttgggaatgtgaatgtgtgaagttgttgtattgaaagggggatagaggtgggagtggagagtagaaaaggagggaaaagggaaggagaggtggaaagagagggagagagaaaggaaggagggaagaggtgaggagaaagcggggaggggcggaagaggggagttggagaagaagggaaaaggggggggggaggggggagggggtgggggggggggggggacacccctctccaactagagtacataaattggaagtagcctatttctgttcctgtttgatttgttggttcttttggatgacgcactaacttctttgcaggaaacctaagaaaggaaaggcacactcctgttttcagtcatggcaccaataatgggaacaaatactattaaagttgaacaggaggatgcttctctccagccctttgtgtctgtttctgtattgtcctgacgtgtcttgatgtccattgcactctagtgccattttgtctacataccacttccacattcccagtgacctcctcctccctgtgtcgagtttcttgtctatagagcagaattcctgtccttttatccacaaaacagagaccaagcccttacacttctatttttccttacatttattttggtgataacattttgaatattttatttcttgggcagtgctcagtatagtcttagaacactgctattaaattgccagattatcacacttgatttacagagttagtactgtttattgagacagactcatggcttttttttcctagtgtgtttgggcatatttcttaatatgaagtttctcaattttcaccatgtgatttcaccctgttttgctgctgttttacattgcatgaagcatgactaaatcatcatcaatggcatttaaaaaaaaacttttgggttaatagttccaggatagcttttcaataatgtgttatctaagacaatattgttgaaaacatactgttgagatgcctacttgttcatcttttcaagttacttttctctgtgattgtaatcactgtcatgtgtttgtgtttgtaattgtgtgtgtgtgtgtgtctgtgcgtgtgtatttgtctgtatctttttccaaaatctgattcttctgttgtttttttgagtacatgtgtataaataaaggtggcttcctgtcagtttggtattattgatatgatccaactgcaagaagttactgcaacactttgcatcttaaaggtccacagtggttgcacctctgctgttggcttttggcctttgagtccttttatcttgtggtgaaggcatgttgtgatgtaggcatgacttgtcctaagtataccagaaaatgatttggcttgctcccagaaccaaatatccagcattatcctttctagatcacctctctgttccccatcccatatggctaatatttttttgtatgtgcgaaatatatttgaaaatgccatttctaaagttactgagatggatgcaggctgagtaagtcctcaccagtatctctggtggaccacagtggcagtcatttgagtctgaccaactgggagcaatctttatcatgctgtctgtgtgtaagtgaactgggcttaagtatattgacatatgaaatacacaactgtgtctccaatggtatcctaaagtaaaagtgtgtgtgtctagttgtgtgggactccagcagcagcatgtatttgaaagcccagaaaaaatgaaaagttccagaaaggtgataagatttgagatgtggggtttctctgaactgtgcctgcacatagcctgtaaactacaaatgcagtcatactctctgagaggggacacggattggttcaaacaaagttccaactgagagtcattgtatatgaacttgtgtgatcaaagaagcctcttctcaatggcatgattcatctgggcatagcatgaatggaaaccctaaatggttcttatttgcttgctttagttaatgaagtcccattagcttgctagacacaaatataattactacgttatcaagcacaaagtatgttctcatataagtcatgctattttttaaaaattgcctgaggaatggtacattacacctaccaaaaatgaaagggagaggagagaaatatatatgtatcatatttacccataatggatagaagtttccttaaacaatatctgtttcacttgaattacgaatcataggttgtcttcagaaacaggaaacaagtaaagtttacaatgattgaagacaaaactagatgtcccccagttatgcacaagtggtggagaaaggaatgcattactttcctccatcaagctgcagtcttccaacctgaccagtgtttagcgagagatacccagtgaaatgtgatacaacttgagacgcggtgctcctctcatggagggacctgatagaggcatttccctgcgggactgagccccgctagccaattgcacgtagatgtgttttatgtctaggaacccatatttctctttgaagttttgctttcaatgttgaaatcaattgccccaactttgcaagtggcaggctgtttacatattgggatatttacatattcatacttaacacatctgagagattgctagatcattggccaatcccctagccctagcagaggtgtggtcactcctttaatcggcctgactgatgagaattgtagcttgttctttgaaagaaaactgtgacctcctttccacttatttgtgaaaaaaaggaaaacttatggaactgaggctttaaaaacttattttttttattcattcaacaaatagttgaaatgtgcctgttgcgtgcaaggctctaagcctgctactccaggaaactcaaaggtaaatagaatgtgatcatgttttgtacccctctactcaactgtgggttccttacagaaaatacgtatttgctccatgtaggaggtgagtaaacaaagaataagtcgagacttaaaactagtctgagagcaaaagaaacagagacagcaagggaccacaccagccccgtgcttccagctgtcactggatgttttctgttgaaaccagtaaggtcaaagaagaaaggataatttatatgttccttgaaatgagggaaagtccacctctgccaacatgtccttgttggaattctgttaatggatatatgggctttttctcttagagattttcctgattcttcacatgacacatgttgaagtttatctctgataaactagtgaattatataaagttggagctagagaactgattcagagtggcgcacagagagagagacttttggcagtcagtagaacaaaacaaacttaacattggatactctcctaaagagatcagagatccttggaaaaatttatgtgttcctattagaaggtcaataacgaattctaaagatagtaggcaaaagggggagaaggttatcactatccagaatccttgtctttttatattttgaagaagacggggattagcattttatttaaactttctagatttggaatgtgtatagaagacttaatgtcgaaaatattaaaaacaaaaacaaaaaccagtaatgtagtttctggtgcttcagcgccaagagcatctttatgtatctagatttctttctttcattatttcaaggactggatccattctttagattcccacccagaaggctgccttagccttagcttagtatctgcaaatggttctgccttacaccccacatggggatgatttaaaccccctcacccctgttcacagggaataagagggcatcctggaatccacatgatctgtgaggtaattagagatgctttcgattccttacacaatcagccatagatttaaggaacacaggatacttcactgtgcagacaaaagtcagtctaaattagcccatcaccagatattgtgcagggataaaatgctttggatttccttgcagtcagtggaaaagtctttcaatgccaatagggcacctcctgggtcatttattagcagcagggacaaagtggagggtgatggtgctgtgaggatttttttacctctcagttttataatcacctagctcactgagagtagcaactaagaatttaagaccttctatgtgtcagtcatgtagcacatagtacatactttaactctcttagaggcattgtaagctagcgattattcacccattttacagatgagaagtgtgaggcttacctgcatttgcaaagccaggacccattttacagatgagaagtgtgaggcttacctgcatttgcaaagccagtgcatggaattttttgtgtatgtccttatacattattctgtagcgtacagttctttaccctataatttcatctcattaatgggcaaggtattttgataagaagactgtattatattccatggggtcagctagagaaaatctgtgataactttgttgaaaatgaaatacactttggatttttttttgcaagaattaaaaaaaggaacaataacccacatgcattgagccttctatacatcatctctcttaattctctaaagattattgttaccattatccacctcttgtaggtaagaaagttgagttctagggatatttagtaactggcccaaagtcaaacagctattaagtggtagtgttggaatttggacccaaattctgattgcagagccagggcatgtaaaaactgccttgcaggaaaggaggtaaaaaaaatgtgcaaaatttataatcctgcctttctaaaacatcatactgaattggctttgaaagataaattcatctaaactgtatgagctctaacacttcaccctcgtgattgcatgaagtcagagggcttgttatacccatgtgaagagttggcggaggggtcattaggaggtgcttatggagagccgctgctcagtgcaggccgtgctattagtgtggactgctgctgtctgatttgggaggaatctcactgctgcctgtggttgtagggcagaacagttaaatcttcatagccttttggtattattgagtgttaataatagtcatgacacaagtacagtttcctcctgtcaggtattgttataagtaatggtagatgttcttgtgaccacaaaaaattattttgcaataatgatctgctcggaggtctcccaaccaggtgaacaaaggttcacctgggtccttcctgtatgactacagacgtatcacttcatgaccacaacacttctctggaatggtttatcagtaggaaaaaagattatgtgttaattaccatcctctatattttgattgtttggggcagctgagaacttcctttagactgattccaaatatctattaccttattaagcaacatcttttcagaacaaggaatacctctgttgtatctgttgttttattcagaatccctgaattcagtatccattaagcctgaagtcttttctcagtctctgcatcagacaatcttgtattctgcttttgatctgcagaaaattaaacttgtttgtttcatccatttattagattaggatacatttatctcttctgtcagtccaaacacaacttggtccgctaatctatttatgccactttgaaataggacaatgtatatttaggttcccacttctctgcagggcaagtttttttaaggggaggtttgcatttgttttctcaatttgcctcaattaggacatgctagacacacatcttattcaaacaccctgtacgtttttataaacagcagactggaattgttaagtatatccaactgctgacttaaaaaaaaaaactgtttgggtaaatccaattcttcctataaaggctgtacatggaatcaatttccatgtccttatcaatgtcatgaagacgttcagcttgcttccgcattggttacgggtgtcttgtaccattccctgcggtaatatgtggtgtgtgtacatgatgtttatgtatatctataggggtcccattaatgctctgtcatttaatggaaaattgttgtagcaatagcttcatcaggccaataatgcttccgtgttgaccaccaatagcagtttcaaaaggaatttattctgatggactttgcttcaaatcatgtgcccatgatggcagctagactgctccattatataaacccaggccctaataccttgatttgctttgatttcctcaactgggagcatgccagcctgggaagtaagcagtagtgcttaatgatggcattatccaactaaatgtatggggcagtggacattggactctggacaaaatctttggggaaagctttagactagtgggccccctataaacacaacagtatggtgtagccttcaaggttttattcagaacatgacctcacaaatgtatcttctctgtttgtttttgttcactgagcagtatattaattaatcctggaaaccatcttaagatccaagaaggtactttaggatttttcatcgcaagtgatgccaaagaagttaaaaggtaagagtttattttcaactggctttctttctggcccggctgtagacaccttgacccacggaagtaggcaggcttccataaccccaaaactccttaacatgtctatggccatcaactggtgtaagaaaaacttccacggactccagttcatgtagtgaattccacatctttgaatgagaataataaaattttagaactaggaagcctagttacctgctcatttattttgtgagggagaaaatgggggctcagagagctgaatgactgctcgaggtcatcctgattcctgatgattcagaacaacataacaagacaactggctccttatctagtgctctttacttaatattatctgggaaatttacttgagaattatcagttttctactactctccctgccaaatagaatttcaaaaggttgggattaatttcagatggaatatgaaactggctctatttctatttgtggcctcctaggtaagtggctgaagttgtcagcttcaattgttaagccactgtaagtgcagcacaggatttcactggcctacatgtttcatgacatttttattcgtatccttaaacctgtttaagcagcctaggaattcacagggccctttgcagcacaacatggaatattattgtatttgattctatcttatgaacttggagaaatttactagcagaaaatgtgatgcaaatgttcagacaggtcattcagctcaacagtaatattgcataaaatattttaagtacattattaattgtgaaggtctatcattagttatataagcctattgtcttcattgaatgagttcctagtcaaagccaggcctgttctaggtgtgctacattctttattgctgctcttcaaaataaccctggaaggtaagtcttctcaaacactcagagctttggtttcctcatctgtaaaatcgagataagtgatttgtccaaggccatgaggcacataagtaagtggtggagcccagagtggaactggtctttccttttctaaaatccactctctttctaccaaatttaataatactaccacattcttacagaggagggtttattacaccccagcactattctaggtactaggttctctgtatctaaaacttgttaaactctcacagcaaccccatgagataggtagcattactctttcccactttacatatgaggaaactgaggcacaacttggctaactaacttgcccaaagccatactgctagtgaggaataaagccaggaagttggagcttgcactcttaattatttgcctaggttaagcctgatacgctgagcacagaacgatgacatgtgaccgtggatacttagggtcctcttcctccccatccactctagcaaactaagccatactggctacagaagcttttgggaaaaagaaaacatgggctgttggaaggaaaaagaattcttaaactgagtgctctaataacttaaatttatttctgcaaattggggaaagattgccatgattgagttgtgggggaaaaatacctccctactcagttcacagaatctcccggttgttcaagagtatcctgagaactgggtacacctgagaagggaaattaggattaatgggactgaaccttccctctccctgtgctccaatcaggtctcctggagaagaagcttgtgcccttgtccagactgtgagacacaaaagcttgaaacagcatctcagcaccaagtacaggaggctggggagcacaggagaaccatatatcacgtatacctcccagatagcaaatataacatgaaactcccatttgtgtaattctatttcctattgcatctctcactaatgaatgtcacaaatatcaggccgtccaaaaaacaaattacctcctatattagggagtgcaatatgtctcatttcagtgctttatggtattcacaaatacatgctgacacaatcagctacaacaccaggctgtaattttccatggcatgtgatgtgtcaaagcaaatgctgtcagttaggggatctcaaatagatgaagactgcaaaaaaccacagaaaggacattggagatttgaatgaaactaaacaagctttgtaaaaatggaaaagtagattatgatgatctcgtatcgagtttgcaccctccactgcaaaaaagcaacaaaagaagttaatgaattctagcttgtagaaaccttcagatgcagtgttttagtaaatgaggagtgaaaccatcccactgcagtcttaagaaggtcacttgaggatgggcatttgggtacttgctctttcctccttgccaccaaatattttccttttaaaataacgttggaacatagactttaatataggagtcacaaaacggtggctcagtgactcagtttggcttgcacatatgatccttttgagtcacaattttaaaatacaaatgagttgccaaggtgaaaaaagttacgagcttttatataaaaatccttattactcatttctcctgaaaaattggcagacccaacaataccgggaagcagtctcaaactcactcattcattcgcccatcaaatgtgtataagtcgtttacatttagaaggctctatacaaggcaccagggaaacagtggtgaaaaatgaacaatggggagaagtcccaactctcgtggggctcatattctaggcaggaaagaattacagttttttaaaaaataattagtggtaaaagaattaatgcaactgggtcactgatttgggttgggtataagtgaaagcttctcagaggggttggtatttgagcagagattgagatgaagggaaataatccatcaggcagggatcagataggaagaagagatgggctgggaagaagttcattgtggatagggaccccaagaaggaaagtgcggctagggaatagatttggggagagtggtatgagatgaggttagagagaggcagaggctggctcctaaagcactttatagaaaggttggatctgttataaaatggaagtcattgatggctttaagctgatctgatgtatattttgaaaaggtcattcttcctgcattgtagagaatgagaggaatggggcaggagaagaggtgagagactcagcgcctattgcatagtttaggtgagagatgatggcagcttggactgacccctgagtggaggtggagagaggtgggttcccattcaggctgtatttgggagagtgtgcagaaccccccaatgaattgggcagaagtgaggaaaaaagaggaatgaaggatgaaggctagagtcagggcttagattgtgttgatcttaaccaagatgagggatactagagaaggagcaagttttgggtagtaggaagttaagcattctatctgggctatgttaggtaggagatgtgtactaaacatacacacagtgatatcataaggcggttggatcttagagtctggagttctggggataagtgtgaattggagatgaatatgtaaatgtgggtgctgtttcttgtcctggcaagaaacagatgacaaacttaaatgggaaaaaggaggagagttttatgaagagactgtaaagttatgggcaaatagtaaaggaaaaccaacaagggatggccaagcactgcagagctagcaagaaaggggaagccaccttcaccctagatctgtggggtcaaggggaaggagggctatcaggagctggagagagaggctgtcgtgtgccatttcatagacctgtacaggagggcacccggggggtcaaggtggtgacctcatcccccctcaccctagtctcctgctgactccttccactggacacgcaggccaggaaaccagaggacaaggagaccatacaggccagccttgcaggacacaaagctggtctgatgatgggtgaagcaagatcaccagctgaaggctgcttgtgggaggggtacggtgagctggagcaagtggagaggagaggagagagagctgttttggagtgtgagaaagcaagcaacaggagaatggggtagatcccaaagagtggaaaaggcccctgaaatccatggttgtgggtttaaagtgaggtcagcatgttttctttcccagcgaaactccgttgctcaggtgcaggtgtgcagtaagggaggggctttgcgaggtgagcatgacagaggcaaagatgggtggggaagagaatgattcttgcaaagaaatgccacttggcagaggtcagctgagcttagatactctgcctgctccagatcaccatggacacccccgacccttgcctcatttcacttattaaccttaattgcctagccttggaggacattatgcttagtgaaataagccaggcaaacatcgcatgttcttatttacatgtggaacctacaaaagttaaactcatagaagcagaaagtggaatggtggttaacaggggctggggttgggagggattggggagatgtccatctaaaacatgaaatttcagttagacaggtggaataagttcaagaaatctattgttcaatgtggtgactatagttaaaaatgaattatataccagaaaattgcaaagacagatttttttttttttttttttgagacaatgtcttgctctattgcccaggctcccaggctggagtgcagtggcacaatctcggctcactgcaacctccacctcctggattcaagcgattctcctgcctcagcctcccaaggagctgggattacaggtgcatgccaccatgactggctaatttttttatttttagtagagacagggtttcaccatgttggccaggctggtctcaaactcctggcctcgtgatctatccacatcagcctcccaaagtgttggattacaggcgtcagccgccacacccagccaagacagtagattttaagtgttcgtaccacaaaaggtgtgcttcagtttctttatctgtataatgtatatgttaattagcttgattcaactattccacattgtatatgtatttcaatgtgttgcataccacacatataatacaattattatttgtcaattaaaaataaaaattaaattaaaaaagaatccaactttagttcatgaagtaatcaaactttatcttttcacaagtctattcaggcttattatcatgtcatcatctctttagtatagaccttgggctctggtgccaggctatgtgaattcaatctcagctttggtacttttagctgtgtggccttgggcaggtcacttaacttctctgtgcttcagtttccttatctgtaaaatagaaataataatcatacctccttcaaagggttgtttgaggatcaaatatgtttaatgcttataaaatacttagaaccacacctgacatgtagtctgttctctatagatgttagctatatgattgttaccgttattatcattatgtgttaagagcaacaaagggggagggaaaatggccaaaggaagtggacgcagagttactttccccaacttggatgctttctactttcctgttcttcctgtgccaaggcagattgattgggttcttagccacattgccactcagggtcaacagtcagctaggatttctttttattttttttttaatttttttgagacatagatgacagctggcatttaaagaaagagtggagaatttgctaggatagagcaagcattggacttggattcagaagtcctggggctggctgaatcccagcatggaatgactgggcagtccacgacaacctcctcagtttacagatgaggacactgagtcccagagatttaggctgcaggatctccaagacctcgtgtggatccaaaagtcttaacattggtttccaatgagtgccaattataaatcaagtcctgtgaaaacataaaaaggaacctaagaatcaaatggtcaagaattgtgtttatttctgcagccctggtcaagaaaaggccatgttcatagctggcattcagtttcctgttgggagtggtaaaggcaacaagccagggattttgttagttcttggatccagaaggttgtagggttgttccagtgaattttatcacctccccagtactgaaagggcacaggcctcttgtgctgttctaggcactgtgatttcaaatagtgcttgaatgatcttatttttcttatccagaatatctttgacacagctaatgcactgtggaatcacctatggacattcaagtcagattaggggattttctttttgagtgcttcatctcattctccttctacctacctattgcttcaataagctctactcacccccttccagtggtcagctgagctttgctccatagtgagaagaaaaccatcatttagtgcatgttctcagggctggatagcatgggaattggtccagtcagctttggagtaaaataagctgtgaaactccagagggggtttgacagaggaacccactgactcgtggctttcgtttttccctctctgcagacctcctcaactctgtctccctttggctgcccagaaaaggtgctttcagagtgacaagcttgatatttttatttgactgagaaacgacatacttctgccccctcaaatatatatttgaccagactgtgggaattttggtgttgtatttaacttccccaccaagggcccagggctcattgcccacatgtccccacgagtagcatcaaaggctgttctcaaaaatgaaagacgaatgagcagacacagtgtgtcacatcagcaacttttttcccagtttctttgtaaatggaagtttatgaaaaggagcactaactcaaatcacagaatcctgtgtttgaaataaatggtcttgcaacaaacatttccgtctgcaaatgtctaaacctttcaaaagattaaaggaaattaatgctggcgtgtttcattaatttggcaccaccgtggaggaaatgtggtactcatttcatttgggtggattatgaaacgtgtcagtttttccattctctttctccagggcatttttttactgcaaggcctgtcatgatgacatcacagatcccaaaagaataaaaaaatgtggctgcaaacggcgtaagtagtgtttctctccctgtcccctccctttctcattcctattccccaaattccttttccttcccttttcttattagagaaacactaaacatcgagagttttcttgagtatgtttatgtttcacccagcagtttaaagaaatatgaaataaatacctgtccttgctttgttagagcagaggatgaaaaatcaccaccatcaacacctaggaatgaaacctgtgcctagtccctgcttctttactctagaggtgcctcagtagatgtgtccagtctaacagagacaagtatgatgtataataaggaggagaactaaagccacagagcacaaagtgtttttgtatcgtgatttccagtggattgggggtccctgagtatatagggttgagagagaaactaaatctgaggacttggtctccaaaatgggagttgactctttccatttggaattcctgctagttttaataccacaggccagagttggcaactgtgataccttcagactgcccccaagaaaagaactttccactgccaaagggcttcagttgccatcgtccaaaggtcgacctcaagcatcatcgctctttggggtagactagactgggctcagttgtttctggcatattctgtctcaagtcccttctaaagcagtttgccactggggcctcttgagaaagatatagtgagtccagaacgtggaattgtgagctcctgagataccatgacttaagtggtctttgctttgagaaggttgtgccttttgcagtaattatgctgtattgcctaatagaaattgttctcaacccttgaaaaacaaacaaaaaatgatgccatccttcctatggtgagttagtcttttaaaagctccttataatcattgctttgattctcaccctaaccccatgtaattggcaggggtgttattaatcccattttacaaaaagaggaaactaagcttccaagtttgagaggatgagattgctgacagtcacacagccaacatacagggatttgggcacacctgaaggcctctattgattctctgggtgctctaacatttttttgcagaagggaaaggcaatgtgggcagtcttgggtctgatgagtaagaacaattatgaaagagtaccccataaaatccttgttcacaagcagaagccagacagaagagcaccattcctaaagtatgccactgaaggaaggacctttttcattgtactcctagagtggggtacagaaaatgtagaaccagtcatctataaatatcactctgctggagggtaaagaagttcctcaacccatggggaaaattcccttggggtgcactcttggtctagagaagtttctgcagaaatcccctcagggtggggcagcttaggaccatgggtttcctccccctgtttccactgacttaatacagctggtccccttcccccagactcttatcgagatgagtatttattgatatctcaaaacaagagcctctaatttcttgggacaagaattccccgattctgacaacctaccgagaagagcatctaagagagaacaaggcctagaatgaacctcactccccattcaacccccacagaccccatgaatccaaagaccttcttcaccaggcagtccatcccagccatgcttagttggttgtggacacagcagcacggatgagttgaccagacatctcctgaatcatttcaatcagaaggagcacagcagtctgagggttgagggaaataagagagaacaacaaatacaagaggtgaacacttctgtaaagaaacgcttgtagtgaggggttgggaaagggaggaaaggtgaggccaataacccctgacaggatatttgccagaccctcatcccacagagtatcaaggaaatagcaagactgtgattcacatattgattagccgttcacatatttttgagtatcttctttggatgagctgctatttttggtttcagggatggagtggtcaacaaggtaaagtccctgccctcctgaatcctttactctggtgaatggagacaaaccatgatgatgtaaataaataaattcagagatagccagtgctaagaagagagaagagactgcctgagggttgaggaatcctgcagtggtgctactttatagcttggaaggtcaggaaggcctcagtcaggggtgatgttgaggccaagacccaatccagatagggagacgagcaaaggtcaaggtcaggaggcaggaataagtttgtggtgtttgaaggatggaagaaaggccagtggcactggggaaagggtagtatgagatgagattagagacggagacaggggacgtggtaagaagtgtgggttttagtcctatattaggaagcctttggaagattttaagtgaggaaatgtcatcattagttcttagtttaaaagatgtccctggtgtctggatggagagcattctcgggaggaaggagtggaagtggaaggatgaagtgagaacttctctgactcttgctctgacattggaatgtccctcataggacgccatagtggaacacagcagactaaattgtccctagaaataagaaataaggatttggcctctagggtatttttccaccttggttccagacaggtaaacagcagcaggctttagcttcatcctggagagagaggcccataattgtttgaaataattttcttctcttcatttcctttaaagttggtggagctagtgaggtatataatctcccattatgcactgcaccaattgctgcaaaaggcctgcctctacaaagccaagccagtgtaacaagggcctcgcttccttctctgtacatccctgtgcctcctcccccaacctcagcttcttcatctcacaaaggcctttggctatgtaacaatcagaattgtctgaatattgctcctactaattaaaaggccatagaacagagggcaggatgcagatgtgtgtgtgaggtgagggggtggttagaataaaatgaattattaaaaataaacctccccatgtaggtcaggcaagtgaggaaattggagaagatgttttagttgcaaagaaactttaattagaagaaactaggattattaataacacactggggggacccccatgccttcgaacagacattgcttggttccctctctaagttggagaagacagctgacccacatactcatctgtccaaacgtgttagtccaggtattaataattcaccctggaatggtagatcccatgagggcagagctcatgacagtcactggcccttacccatagcttcctaaccctccttccccaacccagccttcccctttcacttccacccctagctcctcattcactttcattcagtaaccttcaacatttcacgtcatctcatccggagaaatatcaggtgcggacattccatttctggaaatcctgtgatagtatagtttaacgtttgcatttctttccatttcttcatagctctctatcaaggaaaagagtcaaattcagctgtctggccgaggagcaagttctcagggtctactatttactcattttctttttctatataacaaaccttgtctaatgatttacatttcttcccccagactctaaaagtttgccaaagtgtggactcctagtggacaagtaatgtctagtttgatgtgtttgaaggaattttctttgacttcaaatcattgacatatctttgatttattttttttctctttgctgccttggaatacggcccctactctattttaactgcacactggtagtgatatattgtgagtaaaacgggttcccagcagcccggagtccagttccccctgtctttctctagaagagatactcttttaattttctgtacagttttagtttcccttttacttttggtatttatgttgcatgtagcagtgacatcatgccccaactccttcatcccccagagtagcctggagccagagagtccccagggagcctgctctccatccatccaccccagtccccgggctctggccagcttcgggcactgtcttatttttctatttgaaaataagaccttgacaacagtgtgtttctcttgaaggccttgtctcaggacttttaagggacactgattaggctgaagtaattaccactataactccagatgcttcatcagctggggtaattgtcatgcttgcctttgataaattatacttggtctcctttgttattgagcttggattcctctcctaaaggaaacacatatgccacatatatattcccatgttgtgatacatatatatatatatatatatatacacacacacacaatatgtaccatgatgtatcagagtatatgtacattcttatatgtaaaaattcatatttttacatataagagtagagatattccatagagtgatgtatttattgcagtacatgcttctctgtatgagaagtgcttgctagataattaattggttactcaactttgggactgtaagtatctcaattgtcttactggagacaagtatttgcacagtggtaattattatctgcagtctatgaagttcccttgctttacaacaaagtttttcttttagtcagtactcagtaggacacacccagttgctttatgaatgttagtcagacatcttggaagatccctttacctgtttaaggcagaaaagctgactggaggagaacattccatttcagcaatgagcaatgtataagtctgaacaagtcaatacaagtgtctgaacctctaacttactcaaggaataggatgcccttttactcaacaagatgtggccattgaggaggagcttttaaggccagcattgagctttgggtctttattcatgtttgtaaggctctactgaaaaggagacccaatctgtggaacagttcagtccaatggctctggaatttggagaagatgtttcaaattcagtcccctcattcctttgcagcaaaagaggcaagttgatcatctgattttggttagtcatcagtgtttggagggtatagattgctcactttaaaaacaaaacacaatgatgaccttcttcaattcaatgcacagtcttgccaaaatcgactctgtggctttcttcatcgacagaaccctttaaacatggcttgagggcatggcccactttcatacctgcagagctgcatactaaattgaatggtccttcagaattggagagaaaatgtggtgtcaatcaaccaacaactctagtgccaaatacttctgccttcctcagccacaatacagtcgttaggggcagaatcaactagctcagtgtgctctgtgctgctgacattaactagctttttctttctcctctgtttttggaaaaccacctggaagacctttcttcttactccagaaggtaatgggaggaattttgctaagtgaagacatcatttctcatttataggacttgaaagaatattctctgattcccagtgccacatcaaaggcctcaccttaaatcctggtggactttttcttccgtggatatttttattagtaacgttagttgctgcagagcccatgaagagtagctccatgtttcttgcttggaaataatccctccttcatttgactgattttaaaagtgaggctgtgacctgaaaagtatctattgattgaatggcagatgttttttttcttccatcccagtcttcccttgaatttgctccatttgaaatctaaaacattttccccagcagttggaaaactccacctgggcccctcagtccagtactgctttttcctgcctcttccaatccaccctggaaattaagattctgcattggaaattggctgacaatttggttgctgatgcaggtggcagatggtgctgaggataggatggaatccaattcttccttccattccaggcttggctcagaaaggccagccagcagagaacctgagtttgacagctgattatccatttgactcaaggaaagagcagtaactgagctgcatcttcaccagccactttccaacaggtttctggtctcatgatcatggcctttgagaatagaggaaaagttgtccaagaacacttctgagaagcctttttgttttaaacactcaagagtaaacaaatagttttgatgatgtccattagggaaatacttctattttgtctctgtaaatagtactatgaagttatgatggaaatgttggttgaatatccacttcactgtggtgaagaaaagcacataaaagctttttctcaaattgtgaaactgccaggacctaggtcttcggaggaaggtgagactcagggtcaaattcttagcaaccacataacctcatagaatccatggccctggtccaataacaagaaccttatgatgtgaaccagagggtaaactgagtccctagagccttgtatttctgctttcctagagttaagttggcctatcggggcagttaattgagcatgaagtttcaagagccctaagatggaatgacaagtagctttggtgttcacacttgccagagacacactcttgtctgctcccagtctcaggaagctgcagcagggctttaaaaaggagacgcagtcagctgccactgaaatagtcctcctgtgccagctgtggctgcagaccctaggctcatctcctaggacctctcaccctttcactgcccctacccctaatcatctgctgtggatcatgagaagccattgaattgaaatgacactgcatatatttcaattctcagagacagcagggtcctctttctgctccttttggagaaaggctagttccaactgcccatgaactagctgctcttccacattgatccactagatgtcctcatagatctactttgtattaccattgacatcctggggaaaaccttgtctgagaattgggatttgggaagggaacaatgggtgactacgtaagaaagaaaattagcaaacaccaaaggagagaggatgctttgtgtggccagggagtagataagaaacttacttctgtttgaaataaatcctgaaattttcaaagttgcactttgagacctaaccttgggaatttaaagtggaactcttcatatctaaaattaaccttctaacctaaatcagctctagaaaaggaaacagtcactgagaaatggaaacaaaacaccagtggttctgaatatccatgattcactgtaacaaaattgaagggttaggaagccagagagagttgagagagatgaggggtggtaatttccaaattaggaggtccatgacttaactttgatataatttaattttacaacttaagagtataattttacacagagagtgttcaattcttctggaacatctaccaccagggagacaactcctcatcagcttttagttaaagagtttgttcatgatttgtataatggcccagaggagagctcttcctggccagtactcatatccttcaagcctgatgaatcgctccaccagatgggaggtcttaccttttaagaaagtggacccagaagtctctaggtgaagatacctgacagggagtcaatggaaatggactatgccagcagtagcgaaaaagagccaccttcccagttggtggcaccttgatctagacattctgattcatgaaggtttgtcaacatgtggggctcaatagtttttaactgtttctgtcttgtctttgagcctctcattgatcgttcttgctgattttgtgtgtgtgtgtgtgtgtgtgtgtgtgtgtgtgtgtggtggcacttgtttgtcttttgagatttctattttgcatttggtgtgagtgtaaaaatgattgggaaggaatgacaagtaatagcatgttttcttttttatgcatatgctgctttggaatgtgactgcttataattaacagttaatcttcttatagcacatggttttttgctgcttcgattaccagtttcagcctgttcctgcatgctaacaataagaaattttagaacaatgcatggtcgccagaacggctaacaataacagttgcaaacagtccctgagagccactggtttgtcactgtgtttcctcctgaactcatatcaaggaggaggtttacatcacccattctgatctgtttgcctctgaacaaatagtttcaaaagttatttcatccccatcatccctccccttatccttaaagacggtatatttataagaactttctttctccacaaatgtgtcagattctattattgtacataaacccaaaatggcagtatggaaatgaaaaccagggaccgttgctaatgagaagcatagcattccagagtttgatgggcttctcttctgctacagcatttgattaaaaaaattgtttttcaaaatgatttatctacggtgaagcaaaaaaatcatccttgtttccctcttctgtgtaaataacaaatcaatatttccagtaaaagaaataagaaagagaaaacaagggaatgtctgcagattgtatgccagatccggatgcatttaagataaatttatgttcatgtctttaattgaagacttttttccctttcttgacttcagccgttgctgtttgtttgggatgtctgggcattcacaccatgccttctaaattcctctgattcaaatgctatagtggaacttttttattttttatttttttttggtaaaagctaaagctcaaaggaatgatataccaccattgaacagggctggggctgcatgatgatctgaacaacagactagctaggacactaaaagaacatgtcactaaaaatgtgagccaagtttacaagaatggagttgctgctgaagagatctctcattcatctcccccagtgcctgttcttcacaatcataacgttacccttgcttgacaaatatactgtatggcaagtcataaaggtcttagaacaggacttgacccatttgagagatttaaacccctcttcctggtgactgtaacattcaaagagggcaaaaccacaagccatattttaaaataagagtgcaaccattctctacaaagaaaaagaaagagtgggggaaatgactttcaaaatggaaggtgtgggtgcagggaataacacctcctcagtttaggtttaccatttggcagtaatgcttagaataaatgtgaattcttctcccacctcgtgagagaagcaggccagttcatgataagtgataagcaaacatgtttgcctgttgtagcatcaaaatgaggtacaaaaaccttctcttgtactgaaatataaattggcttgaaaggcaaaggtgaagggcattggaaactacgatgctgacttccaacaacttttataggttaccactcagtttggatccccaggcagtgcagaacctaccataccagctttagaagagctatcaatgctgcatgcaaattgcattaagatatttcacgtggaacctattcttctatttcatgttttgtcagttttaatcgattttggcgaatattttctgtataaggaaaaaagaaataatatgattaaccaatagcctgattgcttcctgaatttctatttggtggggagagaaaggcagatgcgattttcagatcctctcagctttaagcagaaaatacacccatgagtagctaaatgcattccaatagagcaacatctcatatgcttttggtgatttcttatttgtgaactgcctttaatgtcaaatctgcagcgttagtcttgagtagctgcatttcttatatggacagatttggatatttgttctgtcaagagtaaatttaaattcctgtagccatcatataaactcactctcgggaagttcagcaaaggcatccttagatactgtattaacacgtaatcgtttcacatctaatttgatgaaagcttgtcccagcctctgcctaatgcccagaaatggatggaaattagaaagcctacatattagatatttttgcatcttgcaaaaaccatttattataccaaataagcagctaatttcattgattggcagtgtgtatattttgtcctcctgtattaatcatatcaggggaaaagtgttggttacgttttttgctgtcgataatttgctcttcttcccatttgagaacccgagtgtattcagccatgcccttttcctgtggtcaccgctttacctaggggagaaaaatcatgtgcaacagccttgggagacgataaaggcaatttatattttcgctgcttttttgatgtacaaccaaactgttaccaacaatcactctgcatttttttctgggtcaagactgttaaagtgaactaagacctgtgttaaatcccttcagctcccttccagctgccttgctgtgtgtgaccttgccattaattgccgctcttcctctcctcccatccaaccacacggttatagccaagatgtccatctacaagagaatgagacgggcatgttgttttgattgcggacgttctgagcgtgactgctcatgcatgtcaggccgtgtgcgtggtaacgtggacacccttgagagagccttcccactttcttctgtctctgttaatgattgctccaccagtttccgtgcctgtaagtttaacctcaacacacgtagttccatgtttgtgctgtctgtggtatcatccctgtcttgtgctgtgccctgtggttctgagtcagtcgggctgatgtcttcttcccagtgtgaactcctgtgtgctgacatgttgccccagctgcctatgtctctgtgtacgtgcctaggaaggcctcccttctgattttcttaacttacgcttctcgtaacagcatgcaggactgtgatattacagtctggtgatatctttcctctctctcctttaaataaatataaatggaaattaaagtgacagcatatcacctactgtattaatacagagatatgcagaagtgtacatgttaatatttttgaaatggctgtaaattgaattgtatcaaagggaggaaggaaagggtgtagcgagaacaagccagctctagcattgaattgcttttagtgagcttagatagtttcttagatagtttccaaaatacaacagagttttgatgcagatggatatatatatatatatatatatattttttttttttttttctttttactatgtctctctaacctgtgcctcattcctccagtgccagattttgtcttttgttctggaaacgagttttctatgtctgtcagcctgcactgggctagtggattacagagctttttctcagaatgatgactattttgaaggactgttccattaatatcttttatttttccaatagtatagcccctgtttaactaaggtatcttgcagcaattgtgattccaaatgccaacaaaaaatttaagtcagaaacctctgtgatatccctgagtccatagcacaggcctctgatgtcagtcttctttgtcatccacaagctcagagatgttaaagaacctgtcaaggctatgcagctggtagctggcaaggctgagatgtgccagtttcctgagacctcccttatccttgcttccccatggactttgctgttttcctgatacggttcataagtgaagttcctgaaagctccagtttgagaccctgggactgtgggtcttggtccaagtgcagaaaaggctgtggttccactggaggactttacttgaagtataactataactttgttttcatgttttggtagcatagaaggtaggagatggttctcgtttctgcacttcctcccttcctctttaaagcagccaacacatatattgctaacctcttgctccctgtcctctcaccttccaagtgctcagagctggttgagctacactttcctagcaggggtaggtgtacactgacgacaggaggaagaagatcactgagctcttaagcatttattcccatggaaaatgaactggcttgactcccctgtgctggtgttgaggctggtcccagcagagtgcggctgtgtagccgggatccatgaggcctctagggctcagggaaccgggacttcactgtgtgccatgccaggtgcttatgtttgggcccaaagttcaagtgcaaagcatgatttgtgcatcgagccatattagaggcatttggaaaactttgatctaggaccagagagtcattctctctgattcacgatttcctgctgctccagagcagtgccaagggacaggattcacttcaaagtaatacctaatggaggttgcattgagagggagtgtggactgccatatgggcctaaaatcttggaaagatttctgttacaatccttagatgctaccatatgaatccttatcactttattttcccctgaagagttatctgtagtttgcatgccattacagagataagctagggcacagctgcacagagaacttgtctgtctacgatgtgcagcaagacaccaagttcaaagataggtgctggggaggaagagcagaggagggcctgaggtggcatgaattggtcacatctctttgactgatggtggtgaaagtaaccacaagcccccgggttactcttctgcctaatgcacaacttctgttctcaaataatcatgaggctctaaaaccttagcctagactcagtggagaaaagaaaggagccactctggctctgagctagggccccttggtcatgtcttggcactggccaacaataccaatcacagcacactctgtgtcccccatgtagaccccatggtgcccagtgtgtgtaatttccattatatccaagagaaatcttaattagagggatttctcagctgtgcaatttaatccaaccattgatggagaccagggagaagaaaaccttggggtgggattgtcccattctctaagaaacattctgtgagtggcatgttgtccctcccttgcctccaaaatcagcccccaccagggaacacgtggagctttgggctgcgtgttgaagccttaactggtattgacagctcagggggcgatttgccttctccgtttcatcagtcgtcctgccgtcatcactccatcaaacaaaagcagatttcatccatccctgtgtgagaccactcacctttgaccattaataataagttagaaaaatccattccaatttgagcccctttttgggcctgcataagcccttcttctccaattataaaaatgtctgtctctatgtgaaattccactggcagtgctccaatagcaatccccaggcatccctcgctggtggtggagttgggtggtgcccatttgacagagcaagttgactcaagagcagtggtgagagtgggcttttcattaaatatgaacagatgtgaaatgtagagggtttgacaattagaaatggcaggagaagggcccttgaatcaaagtgaggtcagatgggcggatcagattacttctcttacattctttagttgttctgaaaatcattttgaattagtgtcagcagagccatgatgagttttgccctttgtcttttatgctagggctgtattgtttcccaagacactcattaaaggtcattatactattatggagcttgctttggtcgcagtttcccagttgagccagtgtgctttggagactgcctaattcatttctctctttcctttcgtttccctctttactctattttttttcttataaggggaaaaatttccgttttcaagggatgttaaattgaaacacaaagtcccattatgtgttttgtgaagtgggaagagaagtagctggttcccagaggaatggtaatatattaaaagtgctcacacagttctgaaaacctgccttctaacaacaggggctgcctgctcggtgcacccctctatggaggtgtggcccattactgtggatcggttgagtcatgtgctattatgatagttgtcttctgttgaactcaggaggagatggaaggccagactgtgttgaccaaaagaacttcagaggggaaggactagtttaggaaagacaaaaatcaaaataaaaggtgtcagaaaagtaaggcaaattgtgaccgataaggattcatcacaaaaggattttatttctggcaagactgaaatgttcaatatggtaggctagaatcagtgcatagagtgtcattttatgatcatcttggttttgtttccacttcagatggtcctgggcaagagtcccagctctctcaaaagacatcaggatggtatgggcctcggctttttcacaagtagctgtgttctagtactattaaatgtaaaaaatgaatgtctagcaacatacacatgcacataaatatagaagtagattccaatcagtacgatttcttcccactataattttgtaaaatggacctttctctctctttagaagtttattcttgttatttcagtcttgcctgctatctgattgctaaatgtaatagaaagggacaattaaaattatgatgcagtggcaacgtagggccatactgattcagacctgctgagacctgcctgacatgattctagtcacaaagcatcagtaactctggcacaaacaaattaatcctgtggtagaagagaagcagacctttagacttgcacttggaaccagctttagctaaagtacatgtgtgattgctcacaccaacctttcaatttactaattgtttaaacctgcacaattacatgcagccttttgcaaactactgtagctaattttaaattacacatgacttttatttcgggtataaatataatacaagaaggcattcaactccgatggttaagctgagagaagtccaatatgattaggttgaagggagacgtaccaaaatcagtttagtgtaatatcgagtcttgtcagataataaacaaaaatcagcttatcctgagtagcctttggtttgtgcagacagagaattaacattgtcaatagaactaaagtcacttaagtgaactaatggcattttgaagtacataaaatcagatacaagggcagggggtggaaacagctctaggaaaatgtctataataggacacaccctatcctgacagtctccaacgcctgttaaaggagagttaatttaataagctacatttaaaaatcaacagcctataattatctcattccttttatgtgcagttttaggtgacttcctcaaattccccaaacctaaattctatttgcttattttacttctgggccctaaaatcaattactcccctctttccaccaccactaccagtgagaaaaagacagaaaaaggagagccaaggataataagcacgaatcgatgtgatcatagtttttcatgtattagttttaaagcctgttcgtctgagtctccattttctcccatcttcccatgcttgccgtgctgatgtgagtgcgctctctctctctctctgtgtcaatatccatcacacatgtgcacaccaaacactaccagagcctttgggttgtcccctggctctttagttaccctggcccatgcgtcttgatttgaccctttgtacttcattgcaggaagtaaaaacagagtggcagatcggcctaggcagccactgggtcatcccctgtgactaagacctagtgatgggcctggaaggggcttcttaagacactcttattggtagcaggtgaggctacagaagccactgcctcttgcttgattttgtgatagccacgctgagccataggttgactggaaatatgccttactgtgggccttagctcactctgtgcagtgggcagcttcttaaatcagcattgtaaggcagaaatcatgcttgggcaaaattgcctttgagaaggatcctttacatcgctcatctgtcaagagctcccaacacactgggttcttctccagaataaatagctggttgtttcagttgagtgtcaggtaaagtcactggcttgtatttggggaccttgttgtgctttcaccaccttccaaaaaaagagtatggttgaattcctgaagatgaatacactatgaagatgtactgcaggtagatgaaaggagacgggaacagtaggcaaaaggcagccaacttctcaaaagaaattctttgaaacaggattgggaaacaagaaggagaaaggtcagaatgagggaagctgacagggtcctttgtgtataccccatcatgggacacctttcttcccagggacaccatgctgtaataaatgactcggctctttaaggacaaactagaaaagatgttggcatgcctcatgtaagcccagaagaggcccttatgcaaggtgacatagaaattatgtttgcttttttatttcaggacagtggccggttctcaggatactcatcctgacagcttctaccaccaggcagtgaatgcttcctcttacctccatggtggagggcagatgtggccagttagctcctcatcttccatcctcctccactatctcaggcgacagatgccagggccagcccgccttccacttgagctttcttgtcaaggctctgccttgagcccaaatcctgacctttactgtatgaaataaagtactgatgaacaagcagaggtttgaattagagcaggcttggagcaaatgtcaagtccgtctctgcctctttcctccacctgcaccaggagcctcgattagacccagtgtggagtttgcagcgccttaggctttatgggtctggggagacataacttattaacaaagagttattaaatttttatcaattttacaacacaatgtaaatgcctcctatgaatctacattgtattcattatcatttaaaacgttaattaagtcgaagttgcatttaatttctctctaaatgggcctctgggaagacgcttttagaaacatctgtgggagcgtgcggctcacggagctggagaatcccccagcccgcattcaggatcgccccctgagttgattgctatcacgtgtctgtggctaatttgttgtgatgtgattgggtattgtctcaaattagtatcagaccaataatggtgtgaagtcactcgagagaggcttgtggggcagtggcacaggcttcactgcatcctgccttccttccccatccagacagaaacggacagtgggtctgcagcacctgtggtttccatcatgccttgggattctccttctcatatggtgcccatcatttcagttggatacttccttcatcggagatggatgcttgtcatctggcccagcacatttaggacatttgccagcatgctcttcaaaacgatcttaacatttgggatctttgactcccagtgaagcctagaagctgcaagcacagagcagccaaaaatggaaaccagaatggagtggacctagtaatcataagcaggtcatgctcattggtgaggagagacagagggaggcatactaccaacatttgctgaaaaattatgtttctcttttgaggctagcatcatgttttagtcttatctgagcatggggtcactccccaaagagatctatattctgtgtatactgcatcaccaagggagtgagacttgttgacacagcattactaagaaatggctagttggttaacttggattcatgttacgactagaattagtgtagtctctactcttactgtgtgcaagcaactctgagtacacagggaggatgtgtgtatgtgttgttgctgttgttaaatttaacacttatatagcatttgctgcattacaggcactactccccctattaccacaaatattaattaatttaacccttattatgtggtaactgctgtttgcagttgaggcaactataacctgagacatctgcaatgtgccccatttacagataaggcaactaaggcacaagggtctcatagccagtgagtctggccaagggtctcatagcctcatgtcacagtctcatgacttgccaagggtctcatagccagtgactggtggagctgggatttcaacacaggccgtgtggctccacagagtgtggagtcggttgagttgctcagttactcttgcagttgaatatgatggataagtcacttaatctccaagggaggagaaaaaagtgaggattctggtaatgaaacctcgagataatgtagagagtcctgggggggcctcctgcacagcagctggccacccaatttggctagagtttaagacttacttagcatgcagggaattgacccccctgaagggtaaaatggggccccattcctggcaggggccaggccaagggttttgttcttagtctgtaatatgatagaaagtctttagacagtgcgacactatcatattggtgtttgatcagggaagtgacctaacagaggctttgttttgggagggctgctgtggctgcaggggaggaagggactgactagaggggagctggaagcccccctctcggggaggagacaaacagaggggagcctgttgtgggcgggccccagctgttctgagaagccttcagaaggaagacttgatctatagtctgcaggaccctgcaggtgaagcacattgcccagatgcaaatccaagaagttacagtctttaaaagacagtttaattagtggctctggagcagctgaattccatgagcctaattctccccagctgacctggcagccattgtgattcctagctgggtttgctagagtttccttcttattggaggaagatttcctgacccctgacccaggactaggagacccactcggctgcatccactaccactggccttggggatctactgcttctgtttccttttcctaaccattatttcttccttattcctcatcatcttccccagttcaaatatatcttacatcttgagtgtgttgaaggtgacaggcaggcagctctcacctgctggtgtgaagtattggctcaggctgagcagcagacacaaagcaagtgggagccaccagtggggacagctggccagcgctgaggctcttgcttccagctgcaggtggtagcttcagttagagctcatgggaattattctttaaatccctgtatatggcaaggagacttttctcctcctttctcaggaagtcagcatgtctccttacatcgatggggggaaaataataaagtgcttcacatcccattcactgaaaatccactgtagttttcaaccacttaaccttctcgagtggaaatacaaaacacatttcctgtgaagtactgccacacagagtcctaaagaagtcatgtggcatttctaagtatcatgcacaattttcttttcggttttactgctttgtgcataagacctttgtctgtgtccttacttatgtcagcatccgtgattgtggcatttgtgtacaccattgacctcagggggtcattaaaactgcatggaaaagcacttgagtcctgggttccctcatggtggtaggctgtgcatgctgagaatgccaacttctggaagtgcaatgtggcaaaatgcaccaagccaaccagctgtgtgttgtccttctctctctggggctttctccaaaaccagcttgttgaattacctggatagtcaggggaccctccatcgccacatctgcttacaggggttctgcttccccagctgacctttttcccaaagggaatctaaatggacagagctaaatccagcattgtcagacccttgcatttgaaatctcagagggaattgcaaaggcctttctgtaaatagctagatagtgcctgctttggagggagattgctacacatgcccacagatttttattctgaggagacattcttttgatgtccagctcagatgagcaggactaacaaaagtggcctttcttctcagaccatctcatttggtcatcctcagggggagctaatctctcatattcaagggaaacagcaagaaaaaactcccccagccttttctagtaaatctgaaagttttcattctagccccttcaataccgcaagatgagtcccaccaaatgttcctagagctgcagagaaaaccctatgcaaatagaaaatggaatcttttgaggcagatctgcattagggatgatcaactgcactgagagacttataaatgaagtgagaaagactccagccctagagctggcactgcaccagctgtatcgacagtgcatagatgggcatctgcacaccatagagcatgggctatcttctgggaagggagctgactgcttgcattaaaatgatcttcattttggccaatgtcagctttctgggctggagcctgttggatcacactcagtcaagaaaggacccaggggctgccttccctccctccaaggtcaaaaatgtagcatgctgacatccttggctgggcttcctatattggcaagaatacttgaataggaaatggcctgaaggattccagttcagtaaatatttcatgagtaaaagaatgaataaatgaagggcttcccaacccttaaaggaattggtgatgtgctagaagccagatcgccctagatccatgaagcttcccaaaactttctaagcagcaacttactatatagtatatatatgtaaacataaaaaactgggatgtacaagaagagtaagagggaaaaatgtagtaagaaagaacaaggacatgactgaaggaactagaaaatgatcaaatggcaggtgcaattgatattctttgtgaaggataaattatgggaaagaagatctggaaacaaagtaccagaaaaaaccacataggcaaaaatccaccaatgcttccaatgaggagtggcagggttactaccacatatagagcatttgctctggaaaatcaaggacttgtgacattcacattcagttttattaatttcagcaaacctgattattttggtgtgagtcagggcagcataaaaccaatgcattgggcagggctcatgtgaggaaaggagtctgttgtagctagagaggtgtcagcatctgcaggtgggcacatcaacctgcccaaatgtagagcaacattcgaggccttttatggcggtcagggtaatttgactctgactcgaggtaggcagcttgaatgcaacagcagcacccaaatgattcctcccgcgtggaggtatccaaaagctgaatgtctcatagctattacctattaggagccattattctgtttgttctgctcaagccaaggaagagttttcctgattgttctcaaagctctctcaggctgcaccaagcattcccttacctttgaatggttctgaaatgctctctgcattttgtcaaggctgatctggccatttcttcagtgcagatgagtaaatttccacatatggcctgtaacgtatccaactgagagaacatatccagcagggatgcttcaaaaccaaagccctaaacagatgttactgagaagggatgcacaatgacctgcagagaagagagatgctaggtgaaaataaaagctgcaactatgctaggaatgaagacagggaggaaggggctcaggtcatgtcacagggtctggaagttagggcatgaatgtgaaatttgcaaggggctggttgctggaaacactgctccttcacaaacatcttctattaagatgaagatgggaaacaggcagacatctcctgtatttcctcctctctatgttaggggattctgatgccattcccctcactgtgcagtgaactgagagatcttgttggcaattacagcctgaaattctaggaaacgtcagagcaggcagatacaagggtgagatctgtgcattttctggaaactttggaagtaagtcctggtgaagtcatgctttgacatgttcaccaagtagatgctcatggctataataagagtaatgtcttatgtgtgtttgagtctttgtgcttctcaaggcaccaacatcatctcatttcatctaggcatccccagcatagacatcatgtcctactaccatgtgactttgagtaagttccagaacttcactattttttagcttcctcatctataaactggagataataaggacctatctcacagagtggttgcacgaattcagtgagtgaatatatataaagattgcctggtatatgttgaattattatttttatcatccttcattaacatatgaaattaacaaagaaacagagatgaacttgacgaagatcacatagcggatgagtggactgctagatcagaagcttgccatctcccatagtattgatggaaataataatgataagccactttaaccataactagtgctttttttttttttcaaatgactgactgtcatcaagctagccttataagaggtcatatcagctacaggcagagaagcccacagatagtggctgagagttgaacagcttagtataacagactataaaagttaaatggagtcaatttgtttaatttctaggtcatggaataattgtcccaacagaaataagccaacaaaaataccaagagacagctatatctccccagaacattgatttccatcttgactatccagtaggccttgcaaaatttgtgtgtaaaatgaggaaattggaaggtcatatttctaagtttcctttaaactctgagactctgattatcttccttcttctgattgagaaaggctaaaagtcctttttgcttcaacccttactgttataaatccttctaaaatgctgatgtctattacccaacatcgtggtaggtcctgtgaggaacaattatgtgtgtagaaacctcgtagtatatcagtgttagtcttctgtctgtgagttcgcagcttctagggcaggaactgggcgcacagggacacaccgaaagagcccagaagattcttacaggtttctactttattgtcagcttgttttcttccaaggtgtcttttattttcctcaaggaaagcacagaaaaaggccctctccctaacccggggtcctggtattatctatgctccagtgatttgggggttattagtaatcagaacattgtcagctactgaagctatcccagaccagttcatatgcagtgtctctacaaatggccctgccctcccacaatgaatgctaactgttgacctccccaaagagcctcctcatcatatttgttacaccttgttttgttattgccaggtctccaggaatgaaatcgtgtagcaggaagcatatagggccaaacggggacaccatctccaggcaaaagaggcttcctagttggaatagtacagatttgatggatgaaaataaatgtgtgtcttagattttagcccagctgttagaatccttaggtcctgggatcattagaaaactgtgacttcaggtctcatcattcctcatccccctgaaaccccttctttatggcttgtccatccctaaaataggtctggagatcgtcagcaaattcaaagtgtttttgggagagggagggaaagttggaacacaaaaagaggagaacagatggggaaagaagacattcctgtcctttcaaattccatcaaaatttcttttttgatgatggtcttgatctcaactcatctttttctgttgttattgttgttttttgagatgggacctccttctgtcacccaggctggagtgcagtggtgtgatcatagttcactgcagccttgaacttttaggttcaagcaatcctctcacctcagcctcccaagtagccaagactacaggcgtgcaccaccatgtctggccatatctttgaggtccagttggtgttgagacttcacatcatcacctttcctaccttgctttatgagtagctgggctctgtttcttgttgattttgtaattaattagatgagtgcttggagcaaggccaagactgggcccaagtttttcacccatgccttaccactatccctttctttcagcagacctgatgtgtggataggtctagggatgagtggaatgagtatcaatatgcacatttgaaattctgagttttaccctgtaacactctctctttcctcctaccgatggccaagtcctctgatttggcctccagattacatttcgaaccttttctcaccattgccagtggcactgccaagctcacatgctcatttcttcttcagctagtctgccattgttgcccttcaacctttcaattagttcctcttgccaccaaaccaccaccaactttagtattctaaagcacagactttgtcatgttatcccattttaaagagagagaccttttgatggttccttgttttttaagaggataatttccaactttctgctattaaaatggcattcaaagccctttgcagtttggcctcaaccagtttccctagttccgttctccacataagcatccatcatctaacaattctctagaagcgtcttattctcattactttacacatttctggaaccttttcctgagactgtgattcttttcctctctgcttctagcagattaaaacttacccatccttcagagcaggggtcagcacactgtcccatgggcccagtctggcctgccatccattgtagtaagtaaagtttccttgtaacatagtcactcccattcatttgctcagtgtccatggctgctttcaggctacaactgcaaagctgagtaattgtaacaaaaagggtatggcccagaaagctcaaaatatttactatctggccttttagggaaaaagttggccaacctctgctgtgaaggtacagctcaagtactgccatctctgtgaagccttcttaactagcccacccagaaaccaaattagaaaaagtgaatctcttttctgtaagcctgtaacatttcatgtaaaccccattagacagtttttatgttgaggtttttgtagaagtcaaaattggtctttgaattcttagcatattgcacacagtaaccaagacacacagtgtgaattcaataaatggctgattaacatgtaaactctgttgagaatatgtttccatagtttattaagcatgtatctcaaggaaaaaggtctttcatgagaagctgaaccagaggcaaaaaaaaaaaaaaaagtctcaaggctagagatcttcctttcttccttcttgttcctttataccttcttgaacagaacctttgtttctgaacagccaacagccaattcctttgactgctggacaactcttgaatagattgatctcaaattgatcactgcttcttctgaaggtaacacatttgttccgttgtttctgctgacagcacatggtgggctctgtagtggatctgggggtgctgatgttttctccttccatatgtcattgggtatttgagtcggggtaggaagccatggcaaacccattgcttctgttcatccacctatgtttccttattgatttgaatttatcccaaataaatttggatatttaaggcagggtgtgcacctttaattgttcagaccctagccaatggcctagaccttatctcactggactaatacacaagctaacactaggagttatatctaggcagggtaagcccccaactcgaatcttgacagccctgaaccccaccagattccccttcaccctttgcatctgtccagaattgctcctggaaaccctgtctctccagagtgagtggtagccagctgagatgggagatgggatgcccatggcctatgcctgagaccctcctagtcaagctccctgtctggataactggagacacttcgttctcaaagcaagcattgtgacatttggttctcttcacacatgtgccttacccagcttagacagatggaagaattgaatgtaaagagattctacagaatgtattggaaataacaaaattgtgtatgtgtgtttttaaaggatacccttttggttgccgcatgagttattttgttgttgttgttgttgttagagattaaatctcaataactttttggaattagaatgggcttcccatcagctgaatgggctacacactcgcctccttttcatagcaatccaagaactccactgccttcctcacatcccctgctatgttatcagcatggtagttttgcttgagatcaaatcagggcaacataggaactgtcatttttcatttaccggggccctttgatcccatttgaggtttatttgtttcaagtgagaaacacaatccctattgcatacatctattctttagagtacttttttattttatttttttatgttagagatcaaatcagagttgtaagtagtatggtcattagttatcaccactagatttcacaggctacactttatttctgttcttacaaaatcaccaaccttctctgttgcataatgatcacttccagtgaagccacaatgtgcctttcttgggtacttgggtgttaatttatttcacagtttcctttgcagatgcaatcagagtcacctatcacattcctgtttctgctttttattgtgttcctttgctatcgcgtttgtgtgatcttttcctgaaaaatgacaggtagtgtttctctgctcactgtatcagtgacatattttccacgacttctctattgctattttaaaaatataacattttatagatgtaatcttagttgtttgtaactaggttttgttataggagcaaatttcctaaatggcatgttggtttaggtacattttttaaagaaagggaaaaatattttctgcaaaatagtttcctctaaattgtaagtgaaggaaaagctctgttagtaagattataatgcattttcctgatttcttagtacatcgaaattcatgaacattatttttatgtaagtgattaagttgtggcttttaataacacgttgttagagcaaaaagagctatcccttttgatttacttgtgtatttactgggtgacttacagtgctttacatattagaattggtttgtcaacaattaacattctaggtttttatataacccatacttcaggtaatataggattattaaactacaaccagtgtgttagaaatctgcctactggtaatacaattcttacgtataacagcagctgagaaatactgctgtgtatttatgcatagattgcaagacagatggcctgcaagccgcagaagggcctgacatgcaggtccaccagcaggtggcgctgcttttctagaaataaaccctctacctggattctaggtactctcctcctcctcactttctgccttttctcttgcagattgtctcctttatttctctaaaataaatatctaaaactgttgttgctgttgtttgaagagatatacttccagtacgacaatgcccctcaattgctaaggtttatttgaaatccaacttgcctgatgcagtgcttacttgaagcaagtccaagttaaatacatgttactgtttttaaaaggtaactacacaatactggattcagcactgagattggattgcctatgctatctgattattgttatgtggcaagttcccattttaatctaatatctatttacacaaattaatcccataggcttctattcacctcaggataatgaggggcatttttattaaagtgactgattgatatactgaattaatgttttatataaaaatcaccttagtatgatgttctttcatcaagagttactctagaatccaggctgggtgcagtggctcacgtctgtaaccccagaactttgggaggctgaggcgggcagatcacttgaggttaggagtttgagaccagcctggccaacacggtgaaaccccgtctctactaaaaatacaaacattagtcaggtgcctataatctcagctactttggaggctgagacactagagttgcttgaactgggaggtagaggttgcagtgagccaagattgcaccactgcattccagcctgggagcctgggtgacagagcgagactccgtctcaaaaaaaaaaaagtaaataataatactaataaaagagttgctttagaatccaagtcatccaaagaatattgcctttctctcggggccagaactacattttgacaaacaggatcagagtttctgttaagttttgttctgttttttaggaagacttttcacagaaaagttgatcagctcatcaactagggcatcataaatgaagagagaaatcaaatgtgcaagcaaaactatttttaaaaattattttgtccacacatacccaatttttcaaccgttttttaaaaaagacacagctatatctttttactgttttttttatggtctgcggtattcctttgtacagaatatttagtgcaaacattagcttatgtgggagaaaatgaatttattgaggttacagaaggggagaattgaaatatgtctcaggatgactcacttatttgtttatgtttttcattattaaattttcttcctttttttttttttttaaacagtgtctcactgtgtcatccaggctggagtgcagttgtgcgatcttagctcactgcaacctctgcctcccaggttcaagtgattctcctgcctcagcctaccaagtagctgggactacaggcatatgccaccatgcccagctaatttttgtatttttagagacggggttttgccatattggccaggctgatcttgaactgacctcaagatatccacctgcctcagcctcccaaagtgctgggattacaaatgtgagccaccattcccagcccttcattattaaatttctacctatcaggccgtaaagaactttggaagcataggcagtattttactctttgaataggatttctctcttttgagtttttaaacttttctcaggcatactgcgctaagggctgcaagttgaggatctagataatgtaatgtatgttcttatttaactcacccatgtgattttcacagagaacatcttgaaatgttattgattcaacaaaatcaaggaggagaggattggggaaacattttcttctcagtgaatctattttaaagcactggttttgttgaaaatgattttttgaaaatatggattgcagtcagttttcatgtaaaagtcaaaccctgacgggtttccttccagttctctgtagaggggatgggatcagctggagtagttgaagacaagaaatagccatcctgaaatcagggtaaatttacctggctgggctgtgaggaataggccttgtgagtttcacgggacccctttctgaggcattagataactttattttcctgttgaataagctctccagaaaaaaaagaaaaatgagaacttcaatggaactggacagttgccaagggcctccctgctttatttccatgcatgaatgtgtgtttcttaccttggaaaggaaagtgggctgagcgagctaggcagtttctgatagacttttccaagatgcaaagcccacccactatcctctttgaacttcagtatttaaatcagaagaaaaatagctttcccagaggcttcagattattactaaatattgtgcaaattctatcatttggaatgtaaacgcttacactctctgccctttatacctccaactgtgccctcaaacacattttcctgctctagccaaattgactttcttacagtttatacagtttagtattttccaaccaccttgccttggttcaaactgtgtcctccacctggcatgcccttcccaccctctactgccactccttagtctgttcagcatcatgggtcaagtgccccctgagtgccaggccctgtgctccatctggggatatacgggacctctctattcatcctattcttgtttcaagtcgtcttctttttcttcctttcttttttttttttcctgaacaattctctctctaggacttaacttattgtctaagacatttcatgtagccctcccttgacattctcatgcaacatcttttgtactgttgcatttatgtaacttatgagttcgtatattcgtatttaatgcaattatctaatttctctggctaggcttgtggttctctcttattgtgcatctttaaaaagattttaaagaaaagaacaagaaaaaggtatgcccgacattaaactcagagtcattacaaatcagagccagaagggtctcatacttaactaatgctcatccccccaggaaagggaagtgtcttgccaaggccacacagttgatccaaggcaggcctagaaccccggggctcctgatcactaagctgtgcttctcccctttgcaacatcgcctctgtagctgctcggagctatttattgggaacttttcagggcccagcattgtgagagactcagtgatatgtgaactccaacagaggagcttataagcctagctgggggagtagaacacattagaattgaacacaaattataataatgcaaggcatgagatcagaagtgccaggggattttttaaagaaaggagagaattgatcttgtcataatcatctgggaaggccccctggaggaggcagcctaggctgtcccttcaagggtggtcaagtagtcaggtgaaaggaagacatggtgggagagcctggtgaaggagtcactgcctctctaccccgccatgcctctgccccttcttctgtctcccatgtgtctgcatacgccgatcaatcccatgacctcccagcagaaattcaagggaaagaaaagaggccctcacaatcagacggcgtgaatttcctgtaatttagaggaaacagtggggttcctctgtccccatctgtctttcatttgttcttgccctgaatggttccagccttctccaattgaggtccgtttaaacgttttctggcttttcttgtttttatgacatttggcaaaacctaattatttgacttgagcacttcattggggccatatgaaacaagggacaaaggtgacagttgaatgagatgcaaggctaggggtcaggtgggggtgggaatgctcaccccattctaagtgttggttagcggctcaattgcttggggaaggagagagagtatggacccatgtgaattacaccatgtccaaatgtggcagactggtgtggagaaggacccagcagcagagaactctcattgctctgactcttcaaagccaaggcaataatcatgggtagcatttagaaagagctcaccaggaattcttttaagtgcttttcacattttcagtcaattctcacaacaacctattagataggtactctaattctcattttattggtgagaaaactgaagttagataatttgccaaatacctaggttcagacccaacaatgtggctttaagacctgtgtggttaactcttaacctctctacccactcaatgtgagtaggcatttgtggagggatatcccatgccttaaaatctttatttcggggatggtacacttgagtgtcactggttccagggccagaaatgcaaacatggggtgtctgccctatatatgggggtacagtaggcagcagtggggcatttgagcagctgataagctcctgccccaggagaatggcacccttttggaatgaagactcagtcctctacaagatttttaattagaagttagaaatccatatttgtatggacaatcttcagacttaaagattgtcccacatgtgaaatcctgtgtatcagcaggttggtgccaagctcagcacactggggacagtagttggtcctcaggctgtcagcctgcagccccctggttatgtcacataatcccaaagcatctccgaaatttggtgtccttggtccagtagggatcacagtagatcgtaggacattgaggtatggagtaactggtctgagatcagagctctaaagagggtcagagctgggacttgggcaggtggactgactcaagaagctcatatcctcatgctgttctcactcacaggcagaattctggcagcaaatgatctgaattagaagtcagccgacctgggtcctgggtcagggtctgcgtatgagtgcagctatgacgcaaaagagggtgaggccagagcatccccaagccgcttccagcccttctgttgcactccacaccttgttctccaatgcattgaccagaaaggctcaccatacactagcattataaaatattgcacaggatgtgtccgaggataaattatgatagcatacagataaagattttatagttcaagaacatctatagaaggtgattatgcccttaagaaatatactaaatgctgtgtttagtgtaaagtcataatccacactggtccttacctcccaaggttaaaagcatactgtatttctaaagtgttctggcagaatattcttcgtcgggcacctggcttgcactaaaaacccatgcattttacctttatctgagtttgaaagaaattatcagtgcacccatctggaatatatattagaattctagggggctcttgacaccattggctcaatggaagatatggtatttccggatgagccaatagtaataatgttaataataatagtggtttgtatttatataacatcttatggtttagaaaacagtttcacatatacacaattagattctaggctggtctttaaatatcacaatcattggggcaagcattaatttaaagaatgtaaacagcaaagtgaaaatggaaatgaaatgtgattgacatcttctgccagtcatggctatttgaacctgtttgggggtggggggaaagaaaaagaaagtaacattggtgtcaaaatatgtaagcaaataaaaactttcaccccaaagtggaaatgtaaatcaacattgtgttaaccaggaggatttgatgtgggatgtgaaataaagtccacgagagacctgaccccagctctcttttctgtttctcactctgggcaggtggcaaatctcagattcctgaggcagcatgatcttttctccactccttgggatgcctgacaatttgtaaatccacgaggaagtgtttgttgcaagggccttccttaacaatctcatgcaaacagcatgaagtgatcaaaagaaataagtcttgtgttagatttgccttgtccagttctgtggggtggcagaaccagtacctcaaacacctttgagaaatggtgttcagggctggaaattgggcgaggtgagagaagcttttgccctgggcaccaaatttaagaggagacccaaaacctcaggaatcaagataaatgatagtttcatgcaatattttcaaactatcaaaataaaatattttcaaaataatcaaaatttaaaaaatccaggatgaacagaatgtcataattttaagtgaagacagtataaatattgatttcaaagctgacatttaagtactgaattcactaggggtggaaacaatgaggacaccaggaaactagcagctgtagccatgggtgtgagcccttccagggtgccaggagcagtgtttggtatcttacaggcatttttttcttgatacacatcgggggacctgatttgacctacagtaaatccaaatctatttgattataaaccgtcttagaaaaagagttcctttacaggctccataaattccattacagtccactttgtctttgttaaatgtatgggttggaaattacaattcttttattcacaatgatgattttagacacacagctcagaaagatcagcattcacttaaaaaatatattagcatgcttgtatctattaagcactattgctttgtaagctccagctgatgattttattaagtagactgcaaaaggggaagaaaaatcaaggataattataaattcataaatacataattcattggcataaaatgatttaatggaatggatgtggaattatctatttcctcaagaaaataacagagatattctgattaagcctataatcttgtgtatgtgaaattctagccaaactgatggggcacattttcttttctgaaactacctttgataagaaatgcattacaaactcatcagtttggcttcctgttaacaaagagacagcagccgtctggatcattctggattcacagtgaaactgccacaccatgtatcctccaactaaagctgtgcaagtttgacaaggggcagatgaatccaggagttattgtgcagaggtttaaatctatgcggcagctgacggttgaaataatcatctatatatcgctctgagctagctggggaaaggttgaagctgtatattttcaacatatctagtctaatggttaatctgttgtcttgtacggggctctcgcagggtggactggcagcacacgctgacagcttcgaggaattgctcacggtagatgtggttcgccttgctttccaaagtactgggtggatgaatctaacttagcttgagttggaaaatgtgaaactcacctgactcatgacctcaaacacgagcggaccagcagggctaatagcaggttgggtggtagggacagtagagtcactaagctacctctgttcctcccaatgtccccagatctgtgcacttcaggtgggctccacgggtatttcttttgttatttggctgtcttggcaggttgggaagaacattgttctttgtggagactggaaagcaagggaaatgtgagaagattaaactactgcaggggtcagcaaactttctctgtcaaaggtcagcgagttaatatcttagtctttgcaacccatatggtctctatggcaagtcctcaactttgtcgttagagatggaagcagccagggatggctggtaaaccaacaactgtggctatggtctgataaaattttatttatagccaccaaatttcatatctttttagtgggttaccaaatattattattcttagattttgtttccccaatgacttaaaaatgtaaacacactcttagctcatgtgatgtacaaaaacaggtggcaggctacagtttgctgacccctgaacttgagaaagatgagaaagaagcagctgttggtgcccaggatgtggcaggtttcatccctactctaaaagttgtccctcacaaacgcggactgcaagtgctagggcaacctaaaggagtcaggtttaacttttgccacaaagccgaaagttggcttttggtgtcaggagtagggagtagggagagaaggaaaggaaagttgggaggggctgtttgtattggacttctatacattccccagccctcccagttggatgtaaagtaaaaattatctcccatctcctagtaccttcccattctccaaaccccatagcaaaaattcagggaagttctcgaatttttcttttcaattgtgcatttcctcttagaattccatcgttcatctctgtgtctcatctctaagaaactaatacctagtgatctttgcttgagacttttctttgcccttgaggtaatagagagtctattccagggaaaaagaaaagggctaaaggcaaccagaaaattccaaaaggattttctactgaatactgaacagggcggagtgttgggcaatgattctaacaggtcaagtctacagcgaagatatatgagctgcgattctagatatggggggctttggtacatgctgagttcctctcaggatgcatacagaacatagtttgagattggggttgagggcctatggcatgggtagcatgggcacatctaatttacccaattggattctagaggatccattaggcccgcagtattttgtagagaacactgcattccatgtcatgtggattctgttcatatatttatatagtattttttttctctctcctatggaggagctgaattctttcattactctgtgttgatggactcaaacttacacaattcaggtttcctaggcagtgaatagagccagaaatacaccctgtgattaacttctacataacctattgttccttaaagtctccctccccattttcctattagctccacaaaagccagaaatgcaaaagctccaacaagcctcccttccctgccctggcagcctaccatggggtgggcactccctatgcctgtcctagggcagtacaggtcacttagacattttttgaaattcttattctgcataacgatagattttttaaaaactgatacccattaggttttccaagtaaatgtgtttcctatttcctagctagaagttgtgaaattatcctgccagaataatgtatatgataatgtggttgtttgattttagagaggtgtatatgtttgagatattatgatcgttggggttgcttttaaggggcagcatctttcttcttttcctaatctgtggattaatgttagccgtgatgtcagaggttgcagtgaactaagataacaccactgcacaccagcctgggcaacaaagaccccttgtctcagaaaaagaaaatattagccacgatctttcaaaaaatagatttatagttgatttttatgaagaatactgcagtgcttatcaaacttcttagtgatatgtgctattcaaggttgtcaggcaagaaactctcattccaaggacatcacccactttaactcccctgcaccctgatactgcccactactctctgggcgtagaacttggctccattgcctggcttgcctgatcctagctgtgcttaatagctcagcctcgtcgatggacacatggcattccccaccacgggatccatcccgaaacagcagtcaagtgctcctttacaggaatcatactaccaaattcacagtatgggttgttcagctggcatgtattattatttttgtggttgttttcccatcatcgcttaaggaaacaaccacaccctcttacccgtctggttcgtgtgagaaacagccaggcaccattccatcctccaatccagagactgcgctcttgtggccatgccgtaagactttgagagttaacttgcacaaactttctggtgaaagtcttaaacagtcatatcagagagagcttaggtcagcttgggagttttgttcatggtgaattacattttgcaacacgactgttgtaaaattccaggaattttaccatcactccatacccttcattttagtaaaacaacatttgaaacacccacttttcactggtgtcgctgacggccgaaggaaatgccgtggatctgtctttctgaggagtggcaaactcacggcatttaatgttaggcactgataccacaactaagggggctgaccaagccggcagttcgagacagacagcaaaagtttatcaccaaggattgatgactcggaatataatgattattcagtagaatttgttttagcagacttcaggaaagaatgggtctgatcctgctgctaaactgagttttcggtgtctgtacatgttgtggggtgacggggaactcagtatatttttggaaattataccaagaagattgtcttctgaatttccagaagtattatccctactgatacagatgacaataagacggcaaaaagaattgcaggaagtcatcagggtaaaagaaagggaaaaaaatggcaattcagctgtgagggagaaacttccagtttgattcaaagctattcaatgttaaaattgtttggaacttttctaaaagaaatttcactatggattaatttccattttcttttctccttattgtttggcagtcaaggttgcagctagatcacgctattccaaagatccatttgagttcaagaaggagactcccaattctcggcttgtgaccgagccaggtgaaggaagactgggacccattcccatttttaataactaccctgcagccctcaacattctactttaccatgctgagctcagttgaagaagagcgatgcactactgtggatttcagcttgcacttagcttgttgggcagcaaaataccaaaagggaaaaccgtaaaaaacgattaataataattaaaacgacctcacccccaaactggcagcttgtgcaagacttcagtcggaagccctgttagctagatgcctttgtgttcaaaccactttgcatgactcttattctgagtgactccagtgtgaatatgacattactaatgacctgctaagtgtgtacagatgtgggtttctccagatgtggtgattaataacataatggagatagcggttgactcatgtttatgagttgtttgccttttattacgtttctgagtttatttgctttgaactgttttttaactccagccaataaactcacctttaaatcttaaagggcatcatccccttaaatctcactggggaaacagggcagagggaatgtgccccaggctagagctgagcatcaggtccatctaatgcaggcattagactgaattagggaaggctgggagttgcaatcattgccccatttcactccaaggaccataaagaggcttggtaaaccctgacacagtgtttgcagtctggcgcggctgataaaggaagatatttctttttttaaaaatctagtgaaatatgtaatcattttgaagtaagcccagagttctggccagtgtttctggaagacgttgcttttgcttgaaaacagaatgctgatgaaaagtcgagtaaaatgttgttacagatgttcaactctgcattaaggctgttggaattaccaccacatcttaaatcaattctcagaacattgtctggaggttatgtcattgaaataacgaatcctctttagtcaagtataagcaaacatgttaaaacatcattgtaactttaaattaaactctagcgcaaaccaggggatctgaagcctcattagacttgcctgacatttttctagcactgagtcttcccaaactgtaaaactgttagattcagtgcctattagacaagggagcgctgggaagttacaacagcacattaagtgttatacttagggatgtgcaaaaacaagcccttgaattttatgagtacttggagactggatggagttcagctcctataaaattccacgttagattcctgaacttgtttgtgttctaaagaagtcaggtttctttaaaggatcatatcttcatgtggcttccgcagcatgaaggcaagtgaaaatgccatagatggaggtgtattgtaattagccaaaatgtaggttaaataagagcttgtaaatttgcatcgtcatgaggtagtggcccactacttcaacacgtttgtctttcatgaaagtgagtaaatttaagtctcccttttaattccatttttattcctctcatgtagtcacagaagccatgaaatgaaaattatattttatagcttaactaaaagttttcctagatctgctttctttatgcagaaattgataggatccatataaaggctgataattaaatatggtttatatcctacttatgagaaagaagttatcactgcttctcttgagggacctaagccatatgtaatggtctccattacacagcgttcatatatttaagctggagacattttcccccatctcttcagggaacagatctgcatttttaggctgtgagtgcaggaggaaacctttaaacacaagtttcattttggagaacaaatcccactttaaatgcagtatgattacgatggatgatctttctgagttgcaatgaaaataaatagtttctttgcatagaagaggcataactttactaccagaatgaggtgtctcccttgagctggctaacaggtattaacttgcaactctcccatctgaagatcagtgtagcaacaaggtgtaaagataatggccacttaaccaaagaggattatttgttataggcccaatgcaaaaagggaagccaatgctcagcaaaataatcccacaggcatgctagggaggatgacttctgttcaggtcttaactcatctagattcattgtgtaactggacacaaccatggtagcatctggtgaccttgaaaaatgctagccgtggtagactaggttagataaaaacctttggatgtgggattataaccttaagaagtctaactgaattataaccttaagatgagaaaaacagaacttgcaccccgactagagtgactcacatgcactcacacaaacacacacgtgttatttgctccagcatgctacacaaccagtctaggtcaccctgaacacaatacaccaattgcaagtggcccatattaaaagatgaccttgtcttatacgtctagttagtgcaagactttctacttcattctaagatggggaaagtgcgaaagcatacctacacacacacacacacacacacacccacacaccctcgctgcctttctaccccattattgcctcagatgcctggtcccctatcctgtgaaaggaagatgaattcaggtcaagctcagagtgcctgtttgcttgccgagagatgcatatcaactctaagtgattttttcaataccatttatgtggcttgtatttatttcctttaatcttttaagtgctgtttagtctctgtgtgatttgctttggatactcatttctgataagatgcgatatcatcccagccacatagtctctgcctggagctctaaatgactgatacagtctcggcctgagcttgggccctggtgggtgtcagaggaagcaggtggtacagggggtcggctgtgggtgtttgcaggtgctttcttgccttcatctcttctggtctcactctcaccttacaccacagtcattcccttttcctgcatcagccagggtttagacaagcccaaactgacagcagaataggagagtgtaaaatgtgtaatactttgaagcaggtttggagggtagttggattattaaaatagctttggaagcatgtatcataacctactaaatttatttagcgttttcagggaagtaccatataatgcatgctctaatatgggtcttcctggataataccaagtagctgacatggcactttctcccccatctaagactcctacaccattaacatatatcaagtctcttttgatgtcatcactgctaatatttctcttcttagctttaaggtaactgctgtgcattctgagtttcagggtgctttcctcctagtctgtgttgcagtcaactataagaatccaaagatcttatttttccttcttgatattacagctttagcctgaattgtgggggtggggagaggaggactagaattttgccgctgatgcccctgggtgacaggctgggtttgcatctgctaattatcaagcagttctcttaaaaagaagcatgatgcaggctaatacatctgcaaagcttattagtgggtgtctttgggcaagagcagtagagtgtgctgtggtgtttctaagtgaagcttcacattgcttagcaatctgtgtggtttagacatttggaaaacagcttttggtttccaatcccctgtgctgccctccatccctgccccgctgctgcatcatcagagatttcattcaatggcaacctcctccttcattccggggctctcctccaacctcaccagccccggtgctcctgtcttcatgggttgaaaaaggaccccgttggcacagccccacaagccctccctcctggcagttggagggataagagctgagttgggctggggattattgagccagcatgcaccaatgtgccccgatctgattgaaacattggctgtcaaggccttgaatccttgcctcttttcaacgctctttctctggtatgcaggggttaggaaccagctaagttggttcatctggagaagcagcaggctggcagttatgctgacatttcaaatacaactttatttctgattttggttacaacaaaacgcagtctattactgggcaaagcaaagtaaccaaaattaactctaagaataatgataagtattttttttggtatacagataaatcatgatttcttttttttttttttttttcttatggcagggtgtttacaaactgttttagtctgtttaaagtgtatgttcaaaggctggagtgtaaagaggtgttgccttcaccttctctaagccggcctctttgactaacacatttggtctttgtcattgggtcctaaaagacagccatgaattcctagtgagtgactgagccttgagtgtgtgtcctttgatattttgcctgtattgcacagtctgccctcaaactgttcataatctcatgagctgcctgtatttccagttgaagatgagcagccgtcaacactatcaccaaaaaaaaagcaacggaatggaggcatgcggaactcacccaacacctcgcctaagctgatgaggtaaggagaggggctggttgcccacggtttccctcttagcccttctcttcctcccctcgccctctcctcaccctgccaggcccagagtctcccctccccagcaagcccggggtgggggaggggagcgagatcgttagatggcttcttaaaggctggagtatttattctgtcagcttgtcagcagttaatgatagagctgaaaaaattctgtcatgaaaaacagtttgaaaagctgtttgaaaaatacataggctttaaagtcttagctgtcaccatgtcctgtctgtgtgtagttcctaaacagcagtggcactaatgatggcggtaaccaatcagagaaactcgtgtggttagtttgcctgcggcagtctctttctgctggagtccctccgaggactgttttctgtacttaaggccatatgtgagatgtatcatcacaatcaaaaatgaacctgaagattaccttccttttatcctgtcgattgaaatcaaatttctgttaattgattttgactgataagaaaaagtctaataatctgtggacttgccaaagcaaagttcaaaagtaatccagttctgctcaggctaaaagcaatattaattatgaaatacagcatgcatgtacatgttccctcctttcctcccttccttccttccttccttccttccttccctccttccttccttcccttcttccccctccctccctcccttcctccttctctctctttctccctcacttctttcttgactatggcttcctctggtaaatagcaagtgaagtcaaatttcaacagcgttctgcagtttcttcttcttggcctatctgtcttttatctcccctttttgtcttcaattcatctgccaatcccagcatttttttcctccgacatcctgactctctaccacccaaatgaaacaggagtgatttcagatttgcactgctcaccctatgtggtttctgctctggaaatgcctgccatcttgacattagttttgtcttttcatggccaccggctttgatttttgaaatagaatagtggtgatttccactccccatattcaataacatttgcatgttcctggccctccacatccacctttctggaaaataggcaagggcagtctttcttcatgtggttgaggacacaggttttccgtggaagactcaccctgcccaactccttttccatatcaccatctattcctgttaaatgtttccttaaaagttctctgccttccgcttcacccagccttccttgggtttggctgatttgcatgcttgtttacagtttatgaggaggaataaaatgtgccaactgccaagcttttcgtttttatgatgccagtgtcatgctagcattcatttcctatttactcacctttaggtaatcaccttatctaattctaatagttattcccatttaaagtagagaaaagcccagccactttccttcacctaaatttagagaagcaaataaataaataaagagaagtctgaaaaatctgaaacctttggagccaaattccctgtccctgtttgctatgtaaagtatggctcatttctttgatcttgagtaataataattctgaggagttatactgttttcatatgcttcaaagctgtgtcaaagttttgctgcttaagggtacttctttattctgttggctcttgggtaccaagatgacaggtcttctgtatgaggtggaggcttttttaagtcgtagccttcagcaaaacatcaaattaccaaatccagggtagcatacttctacacaaatgcctttcctgtagatatattataccatatatattaaatactttagtgttacacgctacattttatgtgcaatagaaagtgatggtttgaggtagccttggggggactttttttccacaagcagaaaaagctagtgtatatcgtatcaagtatggtttttacaggactttctgcccgaaggcctttgtaaataagtaatgatcaacagattggctgtgggtttttgaaaagcatgcctgtgtcagtttgcatgatgggggagaattttcaaagtggatcttgctttcattcgttgctggagaggggctgagggaggcagtcatcctgggctggagctgtctgtttcatggtacatcaaaattgctaaacgtgggtcaggtggtgagtggaaacttgccaagctacagaactcgggcttctcatgttggttgcctttgggctgctgctaaggcctcagttcctgtcgctgggatgtcttatcccaccagcccaccatggtctcccttcgcagcccagctggaatgggccatcccatgacaagtgagaaagtcttagacactcctcccttaccacgtctttctatgtcccaggtgctccacattctccatctgacctgggagcaaagatggacccctcctgagccctctctccatatcccttgacttccagtttacagaaagacctcagggccctttgttttacatttgaatatctggcactggcaatgaagtcatgggtccatttttgctaaaccccctttgttgattggcagaaaacaagggctctcccagctccctgtggcttttccagttgcccccgcctcttccgacacctgctttctactctccagtaaatgggactttcaggtcctattcctcatgacctgaaaaatccataaaggaagctaatgacttatttgaagtggatttttcgacatgagtttgtgacttgcagtttgagcagaatcaatcattctgaatgcgggcaggttttagtggcctatgggcagtgacaggaatagctccaagaggaactggagaacccagaatgggctaggatgggctgtaatttaccactgtggcttctgcaaataaaacagactcctgcgtgaaggctccttccaaatcatctgccagcaggagatgcaacggggactctgcactaatggtcttttccttccctttgttcttgtatcaggcttaccctagtgtttaagtgtcacttaactctgcacgatcattaggtgaacagccttgttttgtatatctggatcctgaggtagtatgtttttgagtcacctcaacagaaaacaaccctcatgtccagatagagctgaatggcgagtgtctgggccccaggctgaggacacacgtgtaatgatggataaatttggctccacacccgcagaggaggtgtgagccatggaggcttccaagtccccggctctctctgcctgttatttcccttccttcccggtctcttactgtggaattattgaaggagcctcccgtagttttcctctaaaattaccaagcacccgttgcccaattctccctacttagtggggtggtgccttgtaaggatagccacgtctttcctcatttgtaaagtcctaggggggcacaaagtttgtctctaaatagctaagtcaagagttcttaatttgggggccttaccaaccctatgaaccttcaatgaaaactctctaggaagtctttctaggaaaaaataaaaagtacacttgatccccttttaccacagttgaagcaggttaatggattcctgaaatctcctttcaggatccctggttacaatcacattcagtttattccagagccacctccacatagttgcacgtacaaatgctttttggttgatgagatttctccaatgggtaggtggtatggagtaaacacctgggttctcacactgaatcctcacatggaatccaaaaagtctgtgcacttcggctgcctgcttttaatctttttctcagattagctcccatccagcaaatatttagcgagagcctactgtgtgcaagttgtcatggaagttctttaaggaatctaaagtctagcacccaaatgactttagatcccttaaagaacttccacacagtctaatagattagattagatccctgccttcaaaatgcttatagtttagcagaggagaagacaagcacataaaaacacagaattgggtaagaacaagctgggggttccactagcatgggctgtgagaatagaaagagctgtcattacctctggtttgggaggctgagcctggtttaggaggaggtcttattgaacctagttccataccatgaggagaatgctcaactaataatattacttgtctaggtttaccgagactggatgcctgtaactcactgagtcctaactacaactctataagtagttattactcttgcccccattttacaggtgagtatgttgaggtacagaaatgtaaagtctggtaaatctaggtaagttttccctaattaggatgatggaagacatagggacagtgctcagaccacagtaaatgcctgggtgtggctatagccaggggtctttggagtggcctagatggagtggagaatgtaagagtattctggcacccagtcatgaaggttttgcttgtcataggcattagggaacccctgaaggttttcgaggaggcggtaacctaacttgtgttttgggggaatcactggtggcagcagagagaagggttgggagtcctccatcaggagatttctgagacacacactacataagcacagaggtgtgaaatagaaggcccactcaaccccagcctctgccaaggccgtttgtgtgctaagccattcagggtctgctgtagaatagtagaccaggactgggatacatagttttcccaaggacacacgtaattcctgacatcagtcctgagacctagagttttcctctaaaatcatcctagttttcctctaaaatcatcaagcacccgtggcccaattctccctacttagtggggtggtgccttgtaaggatagctacatctttcctcatttgtaaagtcctggggagcacagactttgtctctaaatagctaggtcaagagttcttaatttgggggccttaccaaccctataaactttcaatgaaaacttcagtgaaagttaggatttacataggatgtatcaggtggacagtttacacagatagcacccagctgggctggcaaggataattgacaacacccagaaaaaagaaattgaacattttgaggagagtttcatgtcaggagacccagaaaatattagacattagtttcctgaatgggaggcaaaatatgatttgaggaaaacagattatcctcttgggcatctcctggtcattaagtgaaataaactcatctacttgttaagtctcatcacctctcttttgactcaaacctttcgtggggtcattttgttaggacttctcacatcagagcctgctagcatgaaagattttagtaatagaaaatggcaaaatggactgagccaagtcaccctcacaattccttccactgggcaaaagaaagaaggaaggcagggacagcttagctaagtaaattcatctcttaatgcacaaactgatagcatatgacaggcctcccccaggactggagaagaaaaaagtagttggtgtcatggtactgaggcttgggtggaccacacaggtccctggacaagttcatgctcagcagatggtcatgaccttgccctcttgtgtcaagagcatcttgtacaacctcctgtaggactgatgaacgtgttggttctcccaggctgtctcccaaacataaaggcaaccatttccttcttctgagaatgctggctgcctaacactagataacatcttaggtggcagcagggaaaataatgcaagtagatagatgcagagaaattgaaaaggaccctagttctgccagggtggctacagcctggcctgagagttttgtcagtgtggctccagggatggccgtcaagtgggagatggggagagggtggtgggcagtggtgtctcgggggtgatgatcattatcagaagagtggaagccctgttgaaggatgtgttaaggcaggagccaggatttgctctgcaaagcctcaggaagtatcaggaaatagtaatcacccaggagccaaggcacccaagaatgaggcagatccagttggaaccatttatggtgctgaacacccaactatgattccttttgaggagaccacctaaggcctaatccagccttctgtgtctgatacaggctcagacagacccgtgtggcctgatattcttgaacattgtgctcaaggtcttagtgactagataccatgttgttaaagaagggtagaacactgaattgtaagtattgcactttgcgaggactagtatttaatttgcttgtttaaatttatttgctgattagctcatgggaagagaagtcagcaagagagagtcattagtgcagcatctagtcagtaaatccccatcaagaatcaagtgttgacacaatgcctcgagttccacagagtcacagagaatcagagtaggcacccagaatgtgaggcgcctccttcaattttgcaccctaggcaccctcttgtctagctgtagtcctggctttgctgaatagaactacagccttataatctgtgtgttgttgacaattgctaacttgggtaggatttactgaagccatatagattctccatctgggcaaaactttatagtggtggttcttatactttagcaggtgtcggaatcacctggagggctttgttaagatatagcttgctggtccacagccctacacagtctaattcagcagatctggcctggggattggaaatttgcatttctgttaaacttccaggtgatgctgatgcggctggtctgggccacagtttgagaaccactcttttgaagaatcagaacagtgagaggagcttgaagtgatgggggcccatctctaagaagtgttcagactttgcactggagaaccaaatagttgcttaattaagaacatctgtctgaccactgacatgagtcctccctgctgattagttacagcagctggctccaggcgaacttcaggcagccttgactggttagagacataatttagggttgtccttcacatcacaatgccctttttatagcaaatgctctgtgtcctaattcatacgcagtccctgtaaatgaaaaatgatgcaagaaccctgattgttcaaaaacaaattgttgcaagatatcagaggtaaatgggttctcactgcacacgttttggatctccacgaaaggtttgctgagtctctgttgactgcttgaagagtgtttggggactagagatgattcatcagttcctttagttagtttgattgcatcctctgctggattctggaaatacatggaagagcaaaatagatccctgcccctaaatagttcaccatctaatggataaaacagacatggaaattattattgccgaaggagcatctctagaagttcccaggaagggaaaataacttcagtctctctggctgttcaggatgatggctttatgaggaacacttgagccaaactgtgaagtctgagaaatgtcttgttagccccatcatggtgccttacataatagatgctcaataaagtcagtatttgcagctcggataaaaggtctgtggagggatgagaaattcacctccttttaatcaagcctctcatctcccagggagaccactgtaggatgcccttaatttggatgggatgctcataatgacagaaaaggccttatcgtgtgataagacatgaggtctcgaaaatcaagcagagaaaagaatgcaattttctagccattttgtaactttcctttttcataacatttttgtgtgtttggctggttttttgtactttcatgtaaatttctgaagtccagcgttgaacccagtgccaccgaaggaactgggatttgctgtctttgcctgtaagggaaattgtgcactttaaaatatgatatcagcttcctcacagcaggtttgctagaaaagggatttgtggttttgctttaggctgttgtcttcaaggcgagctttttctgttcctgttgtagcagggcatttagttcacttcctgagattaattgatgccaagtggcatttcttgctctgcgaatcctcaaaacaaagatcttttgcaggcacacctcagagatattgcaggctcagttccagaccaccacaacaaagtgaatatcgcaataaagcaagtaacacacattttttttctagtgcatataaaagttaggtttacactcttctgtagtctattaagtgtgtacataccttcattaaaataatttactcctaaaaatgctagtaatcatctgagtcatcagtgagttttaatcttctttctggtagagggtcttgcctcagtgttggtggctgctgtctgatcggggggtggtagctgaagattgtggtggctgcgacaatttcttaaaataagacaacaatgaagattgctgcatcgactgactcttcctttgacaaaagatttctctgtagcatgtgatgctgttggatagcattttacccagagtagaacttctttcaaaattggagtcaatcctttcatactctgctgctgcttcatcaactaagtttatgtactattctaaatcctttgttgtcatttcaacaatgctcacagaatcttcactaggagtagcttccatctcaagagaccactttctttgctaacccgtaagaagcaactcctcatatgttcaagtttgatcatgagtttgcagcaattcagtcacatgttcaggctccacttctaattctatttctcttactttttccaccacatctgctgttacttcctccactgaagtcttaaagccctcaaagtcatccatgagggttggaattcacttgttccaaactcctgttgatattttcacctcctcccatgaatcacgaatgttcttattagcatctagaatggcgattctttttcagaagtttttcaatttattttgcccagattcatcaaaggaatcactatggcagtgatagcttattaaatatatttcttaagtaataagtcttgaaagtcaaaattaccccttgatccatgggctacagaatggtagttgttctagcaggtatggaaacaacattcatcttatacatctccatcagagctcttgaataattgggtgcgttatcagtgagcagtaacatcttgaaagaaatctttttctctgagcagtaggtctcaacagcaggattaaaatattcagtagatcatgctgtaaacagatgtaaatgcctgacttcaaagcttcaaaggacaggctgattcttgttggaactaatgcagctggtgactttaagttgaagtcaaagctcatttaacattctgaaaatcccataggcattaagaattatgtgaaatctactctgcctgtgctctagcaatggaaaaataaaccttcaatttgtaaaaaaaaaaaaaaaaaaaaaaaaaaaacaaaaccataatatctgcaaagtgcaatacagcaaagttgaataacatgaggtatgcctatgttcttcttcttttttttttagacagggtctggccctgttgctgggctggagtgcagtagtgtgatctcggctcactggcagcctcaacctcctgggttcaagtgattctcgtgcctcagcctcctgagtacctgggactgcaggcgtgcaccatctgcctggctaatttttatattttttgtagagatggggttttaccatgttgcctaggccggtctcaaactcctgagctcaggtgatctgcccacctcagccctccaaaatgctgagattacaggcatgagccaccatacttggccatgcctgtgttccttattagactttaggcacactgaatttctagctgtggacactggagggtgagctgagatgcaagggttatggggtgaatttctgctaatcattcacataagtggtgcattttgtaaatgcctgcgatgctggtttccctttcttggctgcttagaacactgcaacttggggtgttttgatggagaatgaacaagatatggctgcctccttaaagtgggagggtatgaggtgggcaccctgcagcactggccttcagccaagtagacctttttgttaaggctttgcctctcctctcactggctgtgccacctgagcatgttacttatctattttgtttcccatgtatacacagagcccgataataacagaaattacctacaggtgttcttgtgagtagcaaatcataaaatgtaggtaaaagttttagtgcaccaacatttggaagtgttggactcatggcagctattcatcatagtaacaacaatggtaatagcactagtagcagcaatagtagtagtattaatagtagcagtagtagaaataatagcagtagctctatatctttattattgaactgctctccctttcctgcctcctttcaccataatcagagctagtaatacatgagtgggtcctaagcaaagtataaaggatgataaccataagactagttaacacttcttgaggacatgctctaggtcagatgctgtattcagggcatgaaatatctttactcatgtaatcctcaaatggaatccattgaataatgctaatgattaacattcccattttacagatgaagaaactaaggcaatgtacaacttagcaagtaataggtgagccaagccttgaagacagacattttggctctggagccagggcgcttaaccactatggtatactgtcactaaggaaataggtggtttcctgcccttagtggtatcaacccctgaacactccatttggagatggactctataagtcagactgctcaaattagctggctagtgttcaggcttcctctttgctttaagctgggctttcattggcattgatcctcaaatgcatgtctaagttaaagacggagagaagttaccactctggcagagcagatctaacatgcctgtatgttggtggtggggtagagaaggtggttggagaggggagggatattggccgaaaacctttagaggagatactgggtattacatatatatgtctatgtattcctgaaataatggcgggatgcttttttcccccccttaaatggacaagaaaaacttaagattcaagaagggcagccgggggccttcagctaagggatatctgatatattgtgcctgtttttcttcaaggtgggctattgtgttaattttctaggaatgctgtaatcaagtatcacagacccagtgtcttaaacaacagagcttctcacagttctggtggctagaagtctgagatgaaagtctgggagggttggttcctcccaagggtactgagggaaggatctgtttcaggcctctcttcttggcttgcagatctctgtcttttccctctgtcttcacatgattttccctcctgtggaaaagttggcccaaatttcctcttcttgtaaggacaccagtcctattggatcagaactcaccccaatgacctaattttaacttaattacttctttaaagaccatatttcaaaatacagtcacattctgaggtaccggcggttaagacttcacataaaaatttgggggagaacacagttcagcccataaaaatgaaacagcagatatatctcacatcatagagtttctattaccctaaaatagggcatgtacattggctaagtcgcaagtgacaagtgagccttgaattaattatggtgccttttagggaaattgaaaattactttgtgagtggaagacttaggtaatgtcattatgatgtgaaagacaatatctaatcctggtccttgatttcaactaactggtctttgaggagttgtgggagaggctttggaagtgggtctctatcaccttgcaaactgaagatgttgggatcccttgttcagggagatttctcatgatcctcctttccatacaacaaacggcccaattcctctgggtctccctggatcacagcagtgttgattggtgtgctcaatggcaaatgcttggactttcttctagcaatagaagctttagaaactttgatttagtccctgtggacaactgactgtacactctccacctgttccagagatctctctgcagcacaggccagcctaaggcacttgaaattactacagcaacagccatagtaaagaaatttatactgtctggccagaaacagttacagactctattgttgctggaacgaattgtgttcccagcttactcccagactgtgaaatccagtgagtgtgtaacagtgctggcccttactggagccataaattaatccctctcccacgctgcttacctctcatcttcactctagcaacctttctttacctactcagggctctccagccttctgatatccaacaatggtccagtactttcaaaattcttctagctgtgtctttctccagtgacagcacagtgcttcaaaccttcaggatcttctaggctcgcccaacctttatatgcatatgctcactgtatcccttgctcttgtggaatggctcaatgatagaaaacccactgtcttgggcaacaactcatttcatttttgaattactttcaatttttataacaatcttcctgttttggaaccatgatttttgttctctcttaatctcatggatcattcttagtctgctgtcaatcagtcatactcaatcagtttaatccatcttcaacttgactgtcattgcacatctggagacagctggaaggcctggtctgagtcttctgtaccttaggttaggtggtatggtatggggcatcttcagccatggttttaggtgccattatttggcccttttcatttgggcctcaattctctgggtgggtcctactggctattagtggatcaacactgcaacatgctgagattcctcttcatttctcatggttcagatcaaatgctaatttttttttttttttttttttttttgagacagagtctcgctctgttgcccaggctggaatgtagtggcgtgatctcggctcactgcaagctccacctcctgggttcaccccattctcctgcctcagcctcccgagtagagtagctgggactacaggcacccaccaccatgcctggctaatttttttgtatttttaatagagatggggtttcaccgtgttagccaggatggacacgatctcctgacctcatgatccgcccaccttggcctcccaaagtgctgggattacaggcctgagccaccacgcccggcccaaatgctactttctttgcaaaaccttccttaatgctacccaaataccaggatatgaacagcttttttcttggtattcttgtatcaccttgtactttgctgtaacacttgccacaaggtactgtaactattgaactattggtgtatatatatttttttcctgctatcttgtggacctctctttgactagggactttatcttaatcattactgtagcctccattccatgctcagaataggggattcttattgattgctttactgattcaattggttgctttactgattcaataaaccaaagttagaattccaggtaccatgctggtcagagagggtaatgtctttgttccgggaggtttttgatgttcctcaggtcagtctcttgggggaaatcctggattgtttatatttaaatggtccaggccaggatgagagatatgtggggagtagagtgtagtgtggcatacctctaagacttcctggatgcctctggatgttccattgcaaaccatggcttgagctccagtgtgaaattatgcctggtttctggaaaccactaccccagttaatgaagcttgacattagctgtcttttttctttttattgaagggcgatcgatcatcaggcttgcttatttgcttttctggatgaaagttgtaggccactgttaacaacgtctgactccttcccagaaagaatcaagtataccaaaccaaaatgtatctcctcttccccaaggcacacattttctaaaagtgttttttgtcagcttgctgtttcatttgcttgcttgctgatattatgggaacatagttctgagtatcttttaaatcctaaatgcactaggggcaggtctcaggtcatcctgaggtaatactttctctccaaccagtaaacagggcaagagaatttgaacctggctctatatcttcagggcaagtctgctaatatcctcttgcaactgaaatatgttcttcatgggctggaaagagttaattttgttcattttctcaaacctcttctccatgatggcttttgtctacctacctattccagataatattaatagatatctatgcaactgttaaagactcttcaaggacaaaaacatccctcaaaatgtgctctcaccctgatctgtaaatagttcttatcagcctttttatcttaacatctttgactaagttcagtatttggaagatggcctggtggtttacatacctcaagacctctcaacaatccagacactgagatgctactcggagtgggattgttcttcttttaagatcagatatgacagatattcctatagtagtctagcatgttcgttgaagataactttgcaagttggcttcacatagtatttgtcatttggtgtagtctaaaagcaaattctcaggcataaataaaggcagtgagaaagttttctcaccttatgtgggagtggggagcatattggagggtcgtggtagttattcaaaagcttaatcctaggtttttgggccatggaagagattgctgtcccactctgtactcttgacatataagtgggaagtatcggagacatttcagaaggacaaatagtaaaaagtaaataaaagtcagcctctgcagagcgagactctgtctaaaaaaaaaaaaaaagaaaaaagaaaaaagtcaccctctgatgttgaaatatagaatttcaaaaggtaaaatcactttacaatttatggaatgtgacccgatgtatattttctgtcttgtgttgacaatattactcagaaaagatagctccatttcaagagtggttaagtatagctgggacaatgtcctaattatatggccagttttgcaggaaggaacaatgacttcccaaacccgaggtgctgaatcactatcagagataaaagcatggacattgactatgattcaaggtgcaggagcttatttattgtgctataagcttgttagaactgcctgattccattgcagttcttaaggttgtcagtgaggctctgccaacccactagacgggaggcctttatggaagcatcttccttttccaccaatagacaaggcaatagagggcgaatgttgccctgagaatttgaaacaagtttattaagatgcatctgagcttgaggctctcatctaagatatgcagcagttgggaggtgaaggtggtggggagcatcattggatggttagtgcatatacagttgtcaaggcaaggagagagggtgttgtttagtattgaaatcatgtattccagatgtgggcatttggtagtcagtctgctctgaagtgacatgctgctgaatctttaaaggcttcagccagggagagcaaaatctgattgggcaaattgctaaaatatttaaagtgcagcctgttaaagcttttactgcgaagagcatcacgtcagaagttgtagtcagaaggagcgagtaattggctttccatcctcatgccagtcagtcagcatgaggctctattcctattccttcctcttcattgccgaggctcatagcaaccctttggtgtgtctgtctgtgtgtgtgtatgtgtgtgtgtgtgtgtgtgtgtgcacgctggggagatcgaatagctggtaaaatgagaggaagaggagtgaggtagccttaaaaagggaggctgaatccacaaaatgttaggaagaccatttaggaaaagaggagcgggggaaaggcagaaatgctccctgacaaaggtcacctgcacttccagaagtggggtggtggtttggggcagttgtctctcaaaggatggattctgtaagcagaagaatggccttcagtgacaaccacttcctctgcatctttcacatcctctgagatgtaattcagggggcactttccatttataatttatcacattttccacttaggttttcctgtccttttcttcccaggcatgaccccttgttaattcctggcaatgatcagattgacaacatggactccaatgtgaagaagtacgactctactgggatgtttcactggtgtgcacccaaggagatagagaaagtcatcctggtgagtgagggactgtgcatctgatgttgcccgcttctgccccaaaccacatttgctaggaatggggtttccctagttggacagtgggataatactgtccctggtcctaattatttttgatgagtgaaattctgagcatagattgaagcagctagacctctgatcagaacataagcaatattcagatttttcaatctctgaatatattggctcctcataagagtaggtgagcacttgctgtgggaaagccatggtgggaggtggtatgaacataattcctgtggccatggcgctggtgtcagagcctgcctgtaccaattattagctgcatggcttgggtaattcatttgactttttgcacttcggttttcttatctgtaaaaagatgagatgagaatgaccctaactcatagggctgtagtgaagattaaaatccaacagatgactcagtaaagttacctcttattcttactattattaaatgctgtgaggaaagctgaatgctgcctgtattgttattggtttatagcaatgttttgtattcttatagataatagccttgtgcatctgtgagctttcttagtgcatgttgtagacagggaaatgcatgatgatgcatgacataatgatgacaataatgaactacagtccccttggggaggctggggctcagagccctatttcgtggaaggcttgtgaacatcttcatagcagcagtgggctcacccagtctctcccaggaatgtcagcataggtaacaatccattctactctctgcccttgttctattaacagctttgggtcttaatgcctacactggctttcctacagtttattgtcttgctaatccatgagaaatggattaataatcaggaaagtcagatggaagggttctttctcccttgggcctctaatccccagattggtatgggtctgttcctttttgtcagccaggaaaatcctatcatttctgatgtcaggaccacccttcctaaacaaggactgttctgggtcctcggaatggctttgtatgctaacacactggactttcccctatgctttatctatgtgtatgtgtgttctcagcttaattataaatgagcattaacagccaatacagtatcaagctggaggctgtctcagaggtgggaaagttgcaggcaagagcacagaaagtcagaattcttagcaaacagccgttgtccaactgaccaggagtgcaaattgttctactcgcaaagctgcttcacgtatgtacattctttttgttttgttttgtttttttgagacagagtctcgctctgtcgccaggctggagtgcagagccctatcagctcactgaaacatctgcctcccagattcaagcgattctcctgcctcagcctcccgagtagctgggactataggttcgcgccaccatacccagttatttttttgtatttttagtagagacagggtttcaccatattggccaggatggtctcgatttcttgagctcatgatccgccaaccttggcctcccaaagtgctgggattacaggcgtgagtcactgcacccagccatatatgtacattctgatgtattcatggcacttttgccctggtggcctaaatttagcctgatgttaccacttgtggcaggtcacaggctggatgccgtatctgggacctagggttttaatgacttgcctggatattggtgtagtatgcatgccaactgatattcaatcaacatctcctgccagcataaaaaagtttaaggaggtgagttactacttctatcctatgaaaaataacatcatttaacaaaacatctccaggaggcctactatgtgccacacaccattctagttactggagatgcaatccctgacaacgactgctctcacagagcttgtgttctagcagggtggggctgggggaagaggagttatctctttgtgttctagcagggtggggctgggggaagaggagttatctctaggtagacaaatgagtacttaataacatttcagatatttataggatgctttgaaaaaagtaaagcagcattgtaggctagaaagagactgggaggtgctgtctggaaagtatgatccaagaagccctctctaaagtaacacggctagagataagaatgacaggtagggccagctacatgaggatgctttgaggttgtgtacccactgggcacgggaaactaactactttggggatttgaagatataagagatagtcccaattgtaatttcctggattaattagagagaagatataaaatgtaacccatgaaacagtgtatttaaagctaagtggtaagaggtgcaaaatgctattgaaatgtaggggagaaggactagggtgtgtttaagtgaccaggcaagtcccgtcatacacacataggttgtgcttgggttgggcctggaaggatgcatgggaattccagatacatagagaaatgatcagtttctctctctagtgtgctttaaacccggcaaaatcagacacaccggggctgaggctctagaattaggatattcataaggttctctgggtgatgtagctgtggccagtctgaggatgggtgttttgatcccagatcgaagttcctggggtcagcatctgtgcctcggccactcaactaactgtgccttccccacctccctattctagaattcacttccaccctgggcccagtttatattcctctggcttgttgaagggagctagcctcccaggtgacctggccaattacaaataattaggagccccatcacataacagtgctttatagactggttggctgtctcctggtggcacccaggcacttgcacttccgtgcggcccagataactaactccaggtcttctgcaggaagtggggatatgtgatgtgagctccccagtgggtcttccttggtcacagtttctaaggcatttcttacagcttatgtctccggtttccctggactattgcagagggaaaccaataatggtgacagcccctgctttattctaatgatcagagagtgaaagctagtttcttcctctccttgggggttactgtaataaccctgacattgttgtgaattgcaacattggcatttatacaatcaatgcagtggtcaattctagagattaaatcaagcagagtttgatatgtacagtggacattaatatgcctcccccaaagcattgtaagccacatggggccatccaggcatgcagtgggtggacaggaatgggaggcattgaaccagaaggagaggcagagaaaggtccacggctggcctcctggcttcactagctcagtgaatcaaagggccagcagtgactaaacatttgtatttcctgggaagttggggttctcctctaatagagtgactgtgttctttcatttgtctcctttgtagatagaggtttggagttggaggaagacactggcctgttgctcttactaatctctctctagccccttgtaatgattatttggggagatcttttctctgaatgatttaagcaaaacaggcccctccagaaatgtccctggaaagtccaaggcagcattggacaggggtcagcaaactttttctgtaataagtcatataatgaaaaatttaggtttttcagggtataagatctctgttgctactgattagctctgctgttgtagcataaaagcacccataggcaatacctaaacgtatgagcatggctgcattccaatacaactttatgggaatttgaactttatgtaattttcacagattatgacattgtcttcttttgattttttttcaaccattttgaagcacaaaaacaatttttagctcactgaacatacaaaagaatgtagtgggccagatttggcctgtgggtcgtagttttccactcctggctttaggtagcatgttccacctgctgatgcacggacatctcactgataagtctagaattctaaagtcaaatttctcccactgagcccagtgcaggcatctgaccattttatcatcatctcagcaagcaagccagaaaaggcagctcatttaatcaacaatttcatggaaactaagacttctctttccaaatagcataaatattccttttcctttttattttacctcctgaaaattattatgaaggtctgctcacacatatttatggcatacctttcttaaatcttttgtcaaagaaggtagcaatgtgtatggctatacatttggacagatttattacaaaaatataatacatatacacatgctcaaattatagctctatatggcatgtatataacattgatgaaataaaaataatagcacatagtaagctctcagcaaatatttgcttgattctttgcacaaatgatttatttcactccttacaacagccctatgcagtcttctctctgactcttacccacttctccctgttgtagactcgaagtgaagctgccatgaccgtcctgagtggccatgtcgtggtctgcatctttggcgacgtcagctcagccctgatcggcctccggaacctggtgatgccgctccgtgccagcaactttcattaccatgagctcaagcacattgtgtttgtgggctctattgagtacctcaagcgggaatgggagacgcttcataacttccccaaagtgtccatattgcctgtaagtccaaggtcacattattgatgccttttcttcttttcattcacaaaagaaaatcccggatggatataatagttgtagctttgatcatgcctgtgcttcttcatctgggtatgggcctgaggactcagcacttcccctatgctctgtcaaggaaaatccaaaccctgggagaccttattaaaaggaatttgcagccaagttcagtccctcatcagggatgaagtttagcttgtatcaagtatattaaccatatcagcgtctaaacactctcactcctgcctatacaaaacctagagcattgttatattatgatgtttatagtaaggatttgcttacagaactatttatagcattatacttatggcatttttaatgcttgaagaaacattgatctgtgccaccttctgtttttaactaaataaatgcaaataacagagttctttatttctgctgtacagaaggccaactccttctgcagctcagccccaacccctgttcatttagaagtccagcaacgtgttcatggttgtgtttgtgtgtgtgtccgtgtgtgcatgtgtgcatgatattcttgactgcaaaacattaggacttcagtctgaaaaaacagtctgggactccacaatttagtgtgaggatatgggatttaggagtcatgtaattaactacttcctaatcataatgaatgcatagtccacaaactctcaaaacattgtagagaattatgcatttcaacatttgatgtaattctccacatcacaaattcatgcaaatctcacttatcctccaaatatttttcttgtaagttcacatccctgaaactgagaaacaggggccaggtgcagtggctaatccctgtaatccctgcattttgggatgctgaggcgggaggaccacttaagctcaggagttcatgagcagcctgggcaacatggtgagacctcttctctacaaaaagttaaaaaaattagcctgatgtggtggcgtgtgcttgtagttccagctacttgagaggctgagttgggaggatcacttgagcctgagaggtggaggctgcagtgggctgtgaaagcaccactgcactccagcctgggcaacagaacaagagcctgcctcaaacaaaaacaaaaacaaaaacaaaaactgaggaacatggatttctctacatgttaagaagtctgggttttcccccacttacaaagctaaaatgtattatttctgttatcagcttccaaaacctcagaaatggggggaaaaagagccaagtaatataattcattaaagaacacacaagaatctatccacaagcagtacatgttactcattagatgccaccatgtgcctttacataatgcctgacacaatagggactcaataaatatttaaaggagtgagaaaaagatcggacagttatcttttggatgctgggccaaaaacccactgccttagtgagcacaggcagttgaaaatagtcacctatagacaaacagtcatacacagaggagagcataagcatatatatgctttgctcattccagaaatatggtcgatttgattatatgattccatggttatctttctgtcatgtgctcctccacatagtcccctgacctctgaaagtgtctttgtaaagggtttattattttaccaggatacatgagtctgtgtgtgtatgtgtgtggagagagatgggtatatgtgtgatatttggtatttgtgtgtgtgttttgtgtgtttgtgtatgtttcctcctgtgtgaccttttttgtttgtttgtttttgtttgtttgtttgttttgagtccaagtttcactcttgctgcccaggctggagtgcaatggcacgatctcggctcactgcaaccttcacctcctgggttcaagcgattctcctgcctcagtctcctgagtagctgggtttacaggcatgcaccaccatgcctggctactttttttgtattttcagtagagacagggtttcaccatgttggccaggatggttgcaaactcctgacctcaggtgatccacccacctcggcctcccaaagtgctgggattacaggcatcagccaccgcgcccggctctgtgtgcccttgtacacgttcactcatctttcttcatgtatatgaatgagctgtcatctttgcaggtcatttcaaaccctccaaaatttaacatactcaagcacaatagattttcacaaaatgggccttcacctatgtcttcacagagtttattggttaaacagtaccctgcctatagggccagcccagagaaacataagcgatttctatgtatgtcatttgtatttcttgtagtttgaaatcacgtgtgtacaactgcacagggatcatcttatatcacaattacggctggcttccctacaagatgaaaattaaaagaatatggatgcaggcaattgaagcttatgcactggcaaaatgattcaggaagttggttggacttgttttgtaccaagagatcacaggagaagagggcattctccttctctcaaaaagacgctgctccagagcttggaactagttgtgtctcagcagcaaccacagtgctaaatgccccttcctccatagttgcacaatattttagggcctgagaatagaatcatgactaccagtgactcataaaagagggtagataggctccatctctgcagccaagtctctttccaaagccagttctccagaaagggagattagaggaggacattcccagatatgtgacagttggcaaacccttggtctacacaatcagtgagttgaaggtaactcaggtcaccacacaggcaaagaggaagctagattcaagctagaggaccaatgaagctggtggccagacaggagccccaaaatgatgccgcgtggccactggggagctatggcatggggtggcctgatgattttgctgtggcttcacctgaagacacagagcatgtggaggccatggccctgtcctaacctaacccttctattttccctatgcttgcattcccggactctgttgttacttcctggatctgggatttttccactgtcttttgttgttattttttatgttaaaaaatctgtttactggcttatttattttttaaatgtacctgtaatatacaaatatgttcttgttataaaatattcaagcaatatagaagtatataaagtgaaaagcaaactttcccctcacccccacgaatcctatttcccttcccagagggaattaccattattagtgtaatggctatttttcctgtgctttccttccaaatttacatacatttatatatatgtaattttattttgtgggtttttttttttacataaatgaaactatacttttttttaactgctgtagaactttttttttcacttccccctctatcttaggcttctaaaccaatgcctgcatggagagccagctctgcctctttacctcctgcatacattttcactgtgtgcatgtccaaaagtatatttctccattcctatgttgttggacaattaggtcatttccctgtgtatttttttcttgctgaaaatatgcaataaaattatatgatctgaagcttaactcctttccatatctcttttgcattgcacacattaattccactccatccatagcctccaaattgagccgcacatccaggcccacctcatcactctgtgctcactggccatttctccttggctgcattggaactgctgtcttttgcctgagacagaagtgacccgctattaaataaacaggcatttgaaacccacccccttgttacattctgaaagccagaggttgccacaggacagttacttaaatcaagacaatttccaggcaggaagaagatgtagaaccctggcattattcctctcccgcgtttgttagtaatagcttgattgagtattgagaacaagcttaaaatgctgccatcagcaccgactaccctttagattagcacacagctcctattcccttgaatgtagttaggccagcttaatgtcaaggcataaaaaagatacttgttaaataatttcccaaagctccgactcaatctttaatttgttttcctctttccctctcctctcacttttgctcctctctctctctctctgtctctttctccccccatctctgtttttttttctttcctctatgccaaagggtacgccattaagtcgggctgatttaagggctgtcaacatcaacctctgtgacatgtgcgttatcctgtcagccaatcagaataatattgatgatacttcgctgcaggacaaggaatgcatcttggcgtcactcaacatcaaatctatgcagtttgatgacagcatcggagtcttgcaggctaattcccaaggtaaggacagcctgtaatacttctttgctgtgcctgcaggggacaggggctggcaagagggatatccttcactcagtaattcaaagaggctcacatcagcctgcctggcagtgaaacctgcggtcaccatgatggctttcaaaggggcatctgctgcctcttctttccattccagaatgcaggcttgagacctggtcacccacacacagactaggttgcctttccagaggataaacaagcctttaaatagccaccccctcagctttcccaaggagtggcttcatgaccagtgtcatcagctaaatgtcagagcactgaaaagaagctggctgcacaattctgaccgtttccttccagtatatgtttttgccattgagctgggatgggaatgaagctttgctattgttagagccgcctctaggactctgctgaccaagggatggtaatctctggagagtggcaactctatggacactaaaagtcatttagcaaatggtgacacttgtcagaccacacattttcctataggaggcaaagcagccttaagtgacacacgtctgccttcctactctgcccctagtctttcctgtcatttgctttgggaccctgggcaggtggttacaagtaaagatgtctaggggtctcagaaaggcaacacagcaaaaccttcataaaaaatgacctctgtaatcaggatctggcaggataggatgcaaagcattttccattgagtgacacctccgtgtaggctagccatgaattggaggatagttgttacagacgagctgccagagggtggcattggctgcctgatggggaccagaatcccatcagtccaggatggaagggtgtaggagcacagcccatgagagctatggctactgggatatgaagcatcaccttattgatagcttggcaagtgtctgacctcctccccatcatgccaggctttctagaagctcagctgaatcatgcatcctggacctgtgagctacattattttttgtcaacttgacatcaccaccactgccttctaacatttgcttagcattgcagaaaagccaggaacaatagttcctggaatcctcttccctgcatggctctgggctagagtcagctggtgggagatgggcactggggtgagatttggaaagtggaggagaaagataggctttgattctttggaggcaactgcagccagaccctggcagacccaggttcaaatcttctatcagatgagctttctgggagccagtgtcttcactgctacagactgagagaggggctggggcttctctgaggatcttgagattcacagcagcttctggtcaagcttaagagaaccttcccctttggtggtgcatgtgaaatggcttctgtccttctgacatcaccctgatacagcctgaagcctaattttgacctctccatgccaccgtcctccctgccacacccaaatctaaatcttggtatccacctgctcagctgtgcccgcaggacagcacaacatgtgaaggcctaggagaggctctgagcttactcccagctgcatcctgaagaggtagagcccgcatcctgtgcggcctgcccgggtagcacaggcgagaaaggatgtgagaagacagtaagctgaccttctaggagttgaaagaggcaagctggcatttggttcctgcctttaagcccttgactttcaatatgtgtcctctctgccctgccccagtatgggtgtctgttgggggaggctgttagagttacagaacctcatgggccatcccagacctgctgggtcagaatctgcattccaacaagatccccaggcaactcaaatgtgcccttttaaagcacagtaaaccttcacatgaacaggatgtgaccaacccttggtagatgctcctcctctcctggggaggagtgaaccatcaaggggaaaggaaaacagtgaaagcaatgattctccctttaagtacagacagaagccagcaggaggaggcaggaaaacactccctttccccaacatgcctgtttcctccaaactcgatcatgattttccagggccacagattagaatgtcagtgtataatttagttacatacacatctgatatagttgttccttccagttctcttaaacctcatcccagcctcttagatcctatataaaggccaaactggtaacaattcttccactccccggtgcccaaaagccttctttattcttttatagcacaggataagcaagaaaaataggttttgacaggagatatggaggaaagagaaagggagcttatttttcctccaaagaaaaaaagggcactctttcttttgtatacacacatgcacacagttatggtctgaatgtttttgtaccctccacctactccctgccaaatacatacattgaaatcctaaccctcaaggcgatggtattaggtggtggggcctttgagaggtgtttaggtcatgagggtggagccctcatgaatgggactggtgtccttataaaagaagcctgaggccaggcatggtggctcacgccttgggaggctaaggcgggtggatcacctgaggtcaggaatttaaaaccacttggccaacatggcgaaacccaatctctactaaaaatacaaaaaagttagccaggcatggtggcgggtgcctataatcccagctactcgggaggctgaggcaggagaatcacttgaacccgggaggtggaggttacagtgagccgagatggcaccattgcattccagcctgggtgacagagcaagactctgtctaaaacaaaataaaataaaccaacaaacaaataaataaagtaaaagaagcctgagagagacccctcgtcccttctgtcatgtgaggacactgcgagaaagtcctcaccagagactgaacatgccagcgccttgaccttgaactttccgttctccagaactgtgggaaataaatatctgttgtctatcagccacccagattatggtgtttgttacaggagcccaaatggactaagaccgcacaaatgacagaagaaggcaaaggatgtgtttctatgctcagcagtgattctcgtagacccctggtcagcagtggagaggagcatctgtctctcactagccagcagtctgttctgctccctaagagagagtgtcaaagctctaggcccaccaagactttatgtcccattgttttcttgtctgtctgtctgctcctctcttgtttttgaatactgttctctggtgatactctaaccttgtaaaggcagtggtccagtgggagccatcaacacagagaaatcgctccttccccagagctcacctctggctgcagacccagcactccactccttgggctcctcccagcctgtgagctgactctgtgagctgagtttccctgcttttctatatctgagacccttttgactaactggagtgcccactggcctgagatacttttgtcatccttcatctgggcatttggcatgatcaagctccaagggaatagggattatggggaacaaaaaggatttcatgttactctccattttttttcttttcttttctttccctccttccctccctccctcccttccttccttccttccttcccttccctacattactctcctcttgccccctgccttttctcctttcctcttcttcccctctctctctccctcttcttgtccccctctcctcctcttcctctcctctaactactactcctctacacctccaccaatactaccactaccacaactataacctcaactaaacctattacaacaccaacaactcttatcaactactaccaccaataacatactctatctacacttacaactaacaataacaatctactactactaactattacctaacatttattaactaactactaatcaaccatctactaattattcaactatcattcacctaaccaattaaccacccaacttatcttcactactaactctatctcccactatgtcattgtacgtacgatattatgaacttagcgtagtacgcaaagtcgcgatccagcgtaagttagcgatccgtggatagcgttnnnnnnnnnnnnnnnnnnnnccctccctcccctcccttctttctttctttctctttctttctttctttttctttctttctttctctttctttctttctttctttctttctttctttcttcttccttccttccttccttcctttctttctctctttctctctttctttctttctttctttcgaggtagagtctctctctgttgcccaggctggaatgcaatggtgtgatatcagctcactgcaacctccacctcctgggttcaagtgattctcctgcctcagcctcccaagtagctgggattacaggtgcgtgctgccacacccggctaatttttgtatttttagtagagacagagtttcactatgttggccaggctggtctcaaactcctggcctcaggtgatccactcaccttggcctcccaaagtgctggggatttcatgttactcttatcattttggaaaacaaatctaacttcctctgagtgataactacacagatttctggccactgacaccttgctttccctcttatgtattctatggtcctttatggaacctcatgctctgcattgtctgaagaactgtctccatgtctctagaacctcactgggtagaaatgtggactcaggacaaatgtcatgctcttgggccagaatatgcatgcaaccctatggaaagctgtcctaagatgatataatttagcatgaaaaatgtgcattcacattgagaaagtagagccttcattggacagctgccactgcatgttattagggctcctagactaacaaagcctctcttttctcttctgttctcttttcacactcccttttgatgtcacttttctagcccacatggtgtcagaactgacccagcctagggattctggaccagacactttctgaaaagacccaagatgtgatggcttgttgtcaaaaacaattacagaaaaggtggcatatcccaagccagatggtatatccgatgtgacagttgggtctatgagatgcagttttaatatacagcaggcaaaactgcagtgacaattatataaagcagatgaagctgcttcttgctggtcagcaaacatcagctcagaaccactttacagctctttaccagcaactaagtgcctttatttacagagtgcctgtcacttccctttggctggagagctggtgtattatttagcacgcatttatctggggaaaacatttcaatttaaatcagctggtacaacagtggctcttgccagactgtttccctgtggttcaaaaagatgagaactgagtctgatcttggaagaaagggtgagcagagggaggcaatgtccgctctctgagctgcttcagttcatacctgaaaagagggagcatgccatggcatttcccattctgctttcatattgttttgaaatgatgatcttgtagttgcttcctgcttacccttccatgaaaggtaactcctaaggaaaagaaaaaggaataaatggctgttctccatgcatcaggcactctaaaggcccagaacacaaaggtgaccaaaggttgcttggattcagccactcactatgcttgcaggattcaggtgagtggaggaggtatccccataaacaatgacagtccaaggaaacaaggacgaggctagaaatagaggaacacaaagggatccttggtttaggtattttgaggaattgagaaggctttcaagaagaggtggcatcggccaggcacggtggcttacgcctgtaatcccagcactctgggaggccaaggcaggtggatcacaaggtcaggagatcgagaccatcctggctaacacagtgaaaccccgtctgtactaaaaatacaaaaaattagcaaggcctggtggcacgcccctgtagtcccagctacttgggaggctaaggcaggagaatcatttgaacccaggaggcggagcttgcattgagccaaaatcatgccactgcactccagcctgggcgacagagcaagactccatctcaaaaaaaaaaaaaaaaaaaaaaaaaaaagaagaggtggcatctgtggatgacttgaatgcatgtggctatggagcacttgaaatttaggaattaaatttttccttttaatttaattttaacaaatataaaaatttaaagtgatccatagccagtggctaccatattggatggtgcagtcctagagtgtagacttgtcttgctaagggtttggatttgggggagtcatcaaagatttataggaaaagagtaattaattccatgcttgaaaaagataacaggtggaggcaaagtgagctggcttgagacggagcgaatggaagtgacggcaaagattcctggggatgtgttagagggacagggacaagtacaatttggccccaatacagggtacatataaggcagcagggagagatgaagttgaaatgtgggttgggcattgaggaatttcttttctttcttgagttaggaagctgtaaataattttttatgtgtttatgagttaggaagctgtaaataattcactaggcactggggagctacagaaggtttcaaagcaagagagtgatgggattggacctgagctttagggagatggatctggcagccctgtgaagcattgtttggagtggaaaggaagaagatgcaaggactctggttaggaactgtggctatccagatggaagcctgaaaccttggactggaaaaagaatgggaggttctagaaggagtcactgtacatgcaaaacagtctgcatggatgtgtgtttccttctgggggtcagaggatggcagagtggagggacaggctgcaggagaaagcagtgttgggaggattgggttttagtcatggtttatttccacggggacttagtggaaaatccagatgggcatgaaaagctgaagggtggaaatgaagtccttaatccaggaaaagtttgcttctagcaatctggcccattgctcatgctctaggagcaaaggagagcctcagagagagggagagaggcaagagaattgcaggacagaagtataccatctcagaaagagagggtagaggaaaactttggtagaagccggagaaccaaaagctgagcctgtcccgaatgtcccaggggagggaggagccaagatctcaaacccaagacatatgtccactgccttttttccatattttatgctttatagacacacagacacacacacacacacaaacacacacacacatacgcacacacacacacagctttcctcccgccctctttgacctgaagctatagttacactaaatgaacatccacgtataagcggacaccctcctttctccacatttcaacaaaggttaagagcctcaagtagagaatgacatttttctttggaagtatggcagcagtccttggagagatagcattaattgggggcatagggtacaccttccctatcctaaagtctgagatgtcttttactgttccaaagaagaaaatgtgatttctcttttatctttgtgtgagacagtgtggattaggatctctaaattactggatgacaaaaagcagaacgaaaagggccttcctaaagtggaactctgggatcaaatccacaggacagaatgcattgaggacctctgcatgttaattttcaaatgatcagtaaagacaggctagataaaccttggtgataaaagcatcatttcttttgagcagtgactgtttcatctttgttgggataggagggaatgtgtcaagagctgtgaagatttgaagcagaaatttgacaaacaaacagaaaaatgttgtaaagaggacggccagaatggggcagtgcctggacaacatgtcacttgccaagtggttaagagaacaaagccagcaggcttaaagggccatttaatcttctgctccattggacaaaaaccagggccaatggttaataattaaggagaacaggattttagcccaacataaggaagatatttccagaacagcatggacagcctgcaaatgcagcgagcctcctatccctgactgtctctttgctaaaggagagttactgacacgctctttgtgatgggagggagattggtagagagatgagttctgtggtcctttataactaaggatatccagcatgttcttgatttttattacatagggatctgtgttttatatgatttgcattgtaactccagagggagagctatggtgtttgtcaggattggggtcatgagtcttttagtggaagcattcatgtccttcctgaacggcactgtctttgtgttcaaagatggggagcggacggcattggggtgagcagctgcagatctggcttttccattaattggacagaccaccccatcttcaacttccacaccacccttccacacctgcctttttcccagggctctgccttctcccacttctacaagcctggctttcctgacccccaggctgctcactgtttcttgcagacgcacctatacatgtatcctcacacacatttcccctccttgaagtcagagaagaattttttcagctgctcccatataacatttcattaccacaatattctctctcaattctgaaatggtgataggggagaagccatttctctttatacccactaaacgaacaaagctcagcgctaaaatatttttcttccattgtaactgaaactgctgttggcttccgtcccaaaaaccagaaagacaattatacttaactgtttagagatttataaataccacactggagtagcctctaggtagtaactttagatatctaccccaataattttcttttattggtttgtgatttagatcttatcttgagtcctctataataagagtagtacatttcattaaaagagcttactaaacaataaagaaaatctggcttagggctctgagcagatctcaagtacagaaaggggcctgccctgttacatttcttccgtggacatcccaagatgaatctcatcacaagaatctcaggtgcagatgtatttcagcaaagcagcaattgcagctgttttctaaatgacttcaacttaagagaatttttcctatatagcatatttcatcacatgagagatcctctttaaccctgccatttactattctagtaatgtattcctagcaagagaaacaaggaaaaacaacagcagcagctataataagagactgagaaacttggactactttttgaactcatggagggttttatgccctccatgcatgaaagactttcttggagagtggatgtgcagaagaaaaagtaaaaacagacagaatcatcttttccttccaaatggatgcagagcagattcatgtccccactcaggctgtgcccggcttgtgacaactgtcgtgaagggaaatcttagcttcagagacagaaagcagattttgggtggtcttggggttggactgaacttatggttttagcatctggctctcacatgccagtttactcctcaaaatttgtgtgcctggttaatgccttttttaagaaaatgtaatttttttttcaggtgagccatacaccagacacattcctatgtaatatcttatttaatctccctgacaacctgctgagggagagttaccaccttcattttacagttgagaaagcagagattcaggggaattaggtacctttcccatagccttatagctagtcaagggcacatggagttgatctccaaacatctgatttcaaagtctatgcttttctcggcacatcagcctgtctcttaaaaggcaagtgttatcctgatgagaatgggcctgaagctatacatgtactttcaagggtcatgggggcacccccaggacaaacactcaaggggatgaaagtgctcaaggtgtgccagcctcacttctaaactggtccttgcacctaaggggctgaagtttgttttcaacggttcttgtctctgtgaatccccattttttgagccccttgaccctagctgttccaacaatgagagatactaggattctgttggcttcagtctttcttgctactaccactggacaaatgagtaaatctgggggcaatgtgaagcactgtgcttagcctgtctctgtgaacagtatgactgttggagtctttcttttccgtttttcttgtgaatatagatgggacttcggagctgtaaggaagagagtggaatatttgagacctagctgttactttctttgtgaagacacttaaataacatgttcaggttttatttactccttccatgctcaagcggaagtttccgtgacagcagatgagaatgaagagaccactgtagcgcccaaagcctaggctcagaaaatggtccagagaaattgtcttatagtggggaaaccacagctgtagaatcagagaaaagtaaaggaagtcttgtaatcccatggaccctctaagacacctcatgaaattctggataaggataggtcaactaccctatcctgcatgtcagtttggtttgcatcctatgcatgaggttagtgcccctgttgtctccatagtctatgctgtcatagaagtaatggggtctacaggcaaaagggacagaaacataaaataagttgtatggaacgactttgacacacatacttaaggatacagggcttggaacatttcagtgtattccttgtgcagagtgtgagccatttcattcaatacacctgctgtgaagatagcacacatgcctcaagctggcagataaatctagccagctattcagtgcatttttgtcttcacctattctctataggcaatagctcatgtgcagtcttaaaaactttacttcttttcttaaaagcaacaagagcgaaattccatctcaagaaaaaaataaagaaataaatggccctgaggccagatgcagtggctcatgcctgtaatcccagcacactggggggccgaagcaggtggatcacctgaggttgggagtttgagaccagcctggctaacatggtgaaaccccatctctattaaagtacaaaaataagcctggtgtggtggctcacatctgtagacccagctactccagaagctgaggcaggagaatcacatgaacccaggaggtggaggttgcagtgagccgagattgcgccattgccctccagcctgggtaacagagtgagatcccatctcaaaaacaaaaccaaaaacaaacaagcaaaaagaaaaagaaagaaagaaagaaagaaaaagtggcactgcaaagaagccaactgatttataaatgactttagttctggatttattgaacatttaaggatatggctagtccttaaatgcttcaattatacttcatggaatggtctggaggaaaattattttctgaattccagaaaagcaggatagtccttgagcatcttgttacagatctccaggagagatgttctaccagatgttttcagtgtcccatgcatgctgccacacaatgtgttatgagaaggcagaggtggctttgggctgtggtagtcaggaaagactccagagtaaagggaccagaatttgaaaataagtgtgattaatataaataaaggttccgacaggcatgtggaaagggctgaagctgagtaacagaaggcacagaaacaggaaaggccgagtgtttttcacagagggtcacctggctatttgtgtactaatggtataaccaaggtacttaaagggctcactatgtcaaaggaaatgcttgtaggtgggtgcactgttaacctgagtagatcctccaaagaagagcctgttctattgttttgctgacctcttcatgctcgccaactgccagaaatctttctaaatgcttagcacagtacctcacacctagtagacactcagtagaggtttgtggaggggatggatacatgaatacatgatttaatcctgctatctgttgtttgcagcctgttctctcttaacgtgccctcaaatgacataaagcagccaaatacctgtattaaaaacctacactttccctccaggatttagtctcccttcatttgacaactgggcactggacaaggtttacagagatcaaagatgttgcacttgtctggaggagcctttatcagatggccaggttgtctctaatataaactgtactattcccttaacctttactaatagctcctggccctcaacctttgactggcctcgctgaatgtactattacacagtaccaacccagggcccaaggctgtaggactgagacctccaaagttcaacaaagggcagaaaatatctctgctttctgctccagggagctgtgaatgcttcctgagagcttccctggccatgtagaaatgaacattcctctcagcggtagactggagcaggaggaacttggaagatgtgttttgttgctctagttcatgatagtgaatcacaaacatggctgtcagagtaatgatgcagtcatggagggttaaggaacagcttttaaatcctggttctgtccatcatgagcaatttgacataataaagattccagatttcatttcctcatctatatatctatatattaaatgaccccaccccaaaacaccgagggatcagtgtatgaatacaaagacataatggctgcagaaaggttattaaacatcaaaggctgtagaaatagcactttgcagtcaagttcagtcatggcacacatgggtctggaatgacagcttgggtttgaagcccagatctgccacttactaggcctgggaaaattactttacctctttttatctcaattttctcactaagaatactaaatgcacctggcttatcaaatgactatgagaattcaatgagatacaggactttctattgtccatacagtacctttaagtaagccagaaaaagtcactcttttctcaagacaccttattttcatctgctgaaaaaaatggtgataatctactaatatgtttgaacaatacacttttctgtcatctgctgggaaaaaatattgtcataaatatgcaaatatacaatgcctattgatatgagtggtacccacttagattagctactgtgtagtgcccaaccttcacaaccatacatggcaaccctgaatgaatggctgttaaagcacttcctacctaggatgggagaaatcaagcaatgttagctatttttgttattattattacaattttactattttatttcatcccctcctactcccagattaacaaatcataagttaggattatccacttgtacctagcagccagaattactgttgatctgtttgtctgtaaatatgcatagaaaatagatgatgatagaaaccaacacacctttggaaggtgagcagaccaggtaaggtagactaacaaaagcctacagaggagttgaggaaggactagggcagatgaacagtgagcatggggcgcttcccctccatagacaggctagcatggcgccatgcaacgcagctgctctctgaagcagagattgggacagctcgctgacagaaaacctcatacacttccaacctctggggtttggttgtggtaggagccctgatgttggtgaagtgacacccttccagagcaggacccatgctactccacctagtcaacagatggcacttggcctccctcctttgcctcttttttttttttttcttaaaacagtaattttgggtctcagccagaaaacctatagcatattagttctcaactgggaaaggggtcttgtacctacccctttaaatagctaataatgaatcttctctgtgaccctcctcctacctcttcatagacacataaatatttatatacaaatttaagagttttgtctaccctaatgattttcttcccctccaggtttattgaaatacaactgacaagtaaaagttgtatatattcaaggtttacaacatgatgatttgatatacatatacattgtgaaattattaccaaaatcaagttaataaacacatccatcatctcccatagttactattgtgtgtgtgtgtgcccgggtgtgtgtcatgaggacacttaagatctattctttttgcaaacttcaagtgtactacacagcactatcaactatagtcaccacactttacattacagccccagaatttattcatcctataatggcaagtttgtatcctttgaccaacatctccccattccccctgaccctcaccacagtccctggccaccactgttctactttctgcttctatgagttcaactttttagattccatgtataagtgagatcatacagtatttgtccttctataactggcttatttcacttagcatgatgttctccagttcatctatgttgttgaatgacagaatttctttcttttttatggctgaataatattccattatatatatgtgcaggtacatacacaacacagaccatattttctttatctactcatctgtcaatggacaccagtggtttctatatcttggctattgtgaatagtgctccaataaacatggaggtgcagatgtctctttgagatactgatttcatttctgttggatatatacccagaagtgggattgctaaatcatgtggtggttctatttttaattttttatagaaacttcatactgtcttctatagggctgtaccaatttacattcccaccagcagtgtacaagggttcacttttctctccaacctcaccaacacttgttatcacttgtcttttcaataatagcaatcttaacaggtatgaggtgatatcttattgtgatttgcatttttctgatgattagtgatattgagcaccttttcatatctacttgttggccatttgtatatcttctttataaagatgtctattaggttcctttgcccatttcttaatcaggttatttattttcttgctactgagtatatgagttctttatatagatgggatattaaccctttattggctaggtggttttaaaatattttctcccgttcagtagattggcttctcactttgttgattgttttctttgctgtgcagatttttagtttgatgtagtcccgctttttaatttttgcttttgttgcctgtgcttttggtgtcatatccaagaaatcatcgcccagaccaatgtcaaagagcttttcccctattttttctcctaggagttttacggtttcagattttacattcaagtctttaatccatttgatttttgtatatgctgtaagagaagtgttcagatttattcttttgcatgtaaatattgttttctgaacatcattattcattgaatagactgtcctttacctattgtgtgttcttgacatccttgtcaaagattagttgcccttaaatgggtggatttaattctgaactagcccactgtttttcaaccttagctgcacattgcactcacctggggaacttttaacattcttgaaatgctcaggccatactccagagcaattaaattagacattgatgcaggcatgcattggtgattccaacgtgcagcccaagttgagaaacaccagcctagccccttacttactcaaggaaaccatctctgatccttgtatcaggcagctgatttactaaagcttacatttccatagaaatttatcttggaaatttatttatagaataaatcattctcctaggcatgattgctaggagatttggaaagcatataatgggcattgtgaaaatgcaagatacatgagaaattcacaaacttccacatggttcccagcagggagctagtgggagctgggaaaataaaccagggggtgtccatttgagaggtcaaggcaggtgggcacaaacaattctttgaatacctaatcagcataggaaatggaagaattttgaaaatcaatcaggccatgggcctaaaggcaagcaaggaaggtaaataataataacatcagggttgaggtttcacacttaatctataaaactacttttaataggcccctaggtgattataaattcgtggtggctttctctttattgggattatatgggtctattccatatttccaaaggaagcccttcctattatgcaggtgtgtctccttatttatttatttatttgcatttaagatattgaaacttttttaaaaaaaactcatttctgtgagcattaagtatataccatgcaaggaagcaattgtctctatcttatgaaatattaaatcaaaatgcttcctgttccctcatgtcccagagataaatacagcagtactttgaagcccctcttggagctgttttgcctgcaaatttattgttttgtctccattttcagaaagccctgttttctatgaagtatagcactctaggtagtttttaaggcgcaaactcctctggagttgcctgtgtcggcaacaactcttatgtagatggcacacgagggatggcgcgttgatcggctcctttaagatgacaaatgggcagagagtgttattgtctttgattgcatgccttacatcatctgtatgtaggaataagagggccatactttatctttagccattttataaatatttaagtccttatagttgcctaaagatattaaagcatattttacagtagtcggaatataaatattatatatagcacaagataccaaagtagtttaatgaattcataattttctgctcacatttattggaatgtgttttatgttccaaaagttccatttaaagaataagataccattctactccctgacaacacaccaagcattggccagtgttgggggcggggtctgagttccaatgtggggaagattctattaggaagcatggaggcaggaagtctcttccctggaatatatttcttctctctttaggtctaaatatgtgtgtgtatgtgtgtgtgtgtgtgtgtgtgtgcgcgcgcgtgttcgtgtgtgtgtgtgtgtgtgtgtatttttctgaataaataattctggtgcttatttaagtcccgtagcatttcaaaaagaaaattttatatctcctttcttctgtttcaaggagattaattcaaataacataagtaagagcaataaagataaagtttgcaattttcccgtcctcccatctccaactcccttttgtaaacagggatgcagattctatttgccagtatacaatggtgatccagggtcttaatgtgggtagtgacttcccaatgcattttgaatatttctcctgaaattaaagagttccaagttgcattttccttttcctaaatgcaaaaagatgacagggagaatattactgcacctcttttcaattttccagtgaaatataaaggctttcttctttaatatttcacaaagttcctccagttcccagtgggagtctatgctgggtaatgtttgctaattaccaacaacaaaactagacatacaacgttggtaaattacctgaccctttcctttttaatgagacaacaaggatttcgcgaagtggtgttgtttcactggttaatggtgtcagcaatgttgtaattgtgggttgagacacattagctgaacaaccacatgtagaaagggctttctctcgacaagctgtttggagactagaaccatattatcattaagcctatgtcatttgcatgctgctaatcgcttactttattatcctgcatatccattgtctttctttaattactctttaaattaaaattaaaaatagttttaaagcccacaatgcccgagatagcatcttgattatgaagataacttcaagaaaatggaacaactggttatatattgcctggattatgagagtcccatcgttatgtactgtgcctgcaggcctcaggggcctaattgcggtggtttctcttcctttagcccatagtgtttgtttaataaatggttatttatggccttctcagccattagagcaactttggagaaagtacttccttctccttggtttgagaagtgaagttttatcctctgggcaaaggtataaaactgaatcaaaaaaatctggatgtacactagagcttgtgaaggagtctgtaaggagatcctctggattccctttgctagcttattttgttggagatcacgtttaaaatttggggtcatgaaagagacataaatctcaaagctgagagggccttagagtcattcctattttacagatgaagacaccaagggccacagccattgccacgactgtgatcgcatagcagcaaatgaatgatttgactgttagcaaatggaaaggatgcagggctcctggagggaggatcatgccttaggggctactcctgagagaggatatgatgtgtacctggagttgtgatgtgcaagctacatggttgttgtggtttaatgtatttggtgcgcatctcttgtatgaaatgttgatatgtttgttgataccgacaatgtgataggattctggaagagagggctcctgtgttccacttccttaaaagaacaaccccatgaatgactccacagacattcctgaatattgagtagctgaacacagaattatcgtggtttcaatattatgtatgatgcacggtaatctaaagggatttgggacattgctacaacctcattttatggatgggagaactgagtttggataagacattgaatccttctacattctcacagagaggtaggagttgacctgggactaaaacccatgtgttttgttttctctgtcagcttacaaccctgttgttgataaataatagtaagttagtactgatgaagtacatgctctgtgccaggtgctgttgtaagcagtttccctgtattattattattaactcattcaatcttcatgacatcttcctcttccaatttgcagatgaggaaactgagacacaaaatttaaataaattgccccagatcacaaattagaaacagaaagaggcaggacccaaactcattcagtctagccacagtgttcaagttctagaccacaaatggtatggcttatttcaggtagtggtcaaaagttattgaccacgctgtacagagagatgctcagagtcaaaccagcatcaaaccctcatctagtgaagattcgtgtgtgtatgtatgtgggaatgcctgaccccaagatccaagatcccagtttcctattcatctgccagcataaacgtatgtacaggaaacacttcaacacttaagaaaaaaagattctttcttttaaagaaccatcaactgtttggaaccttggtgctatcttgggccaggcgtcttgtctctagaaccattcagagatagctggctgaaagttgttgatgcgattctgctttcctgaatttcatggcaaggccttggatcacttggcaaacccatcttttacagctacttaattttctgtgtgcttaagatatggatgttatactttgctcgtgattttggagttctggtttctgctgtgctggccatcaattcatactaaaccaaacaactggggcccatttggcatttggtgttttaaatgtaaaaggacatttgaactacatgacaaatgctgaaaaacaaagcccatagcaccaagaacataaagaaactgtttataatgaaaaagtggttacattttcagtcaatctatcactttaatgagctcttcacgtttctttgattaatgcttgcaaaaggggagaaaaaaattgatgtaatggaaacaaaatggtatatagtcttggcagcatgaggggggatgtctgtgtgttttattagtatccccttgatatcattgtcttgtaatgtatatatctgccttttccctggcatagtaagcctctagtttactggaaatgtgatccatcatgaaagaggagatcccatgttagtggcaaaacagcctttgtcctcttgtggtggcagcaaagagggagggtcccagaacaggaattaagaataaataaaaacaataaagaaaggttagcataagctgtgccatattgaaattgggaagtccagtgggtatatgaagataaaacagaagaattaaagatgcttaacaacatttaaacattaatatgtagtaatttgtatatatttagtaataattcatacattttaaaataacgaataaaggggatggaaaaaaaggcagaggaaaacatcttcataaagtaactaaatgtgagaagttattcaaggcagacgtcctggaagaggtaaagaaacgacaggagctgggttgggagggaagagggggaacagcgtttctgaagtgggtaaggctggtgggagcagggatgggcatcagcaggtgccactttccctctgtgttggaaaccagctctgactgctcctcccttcccctatgtgcatggggcattgtgggtttcttgggctcttcactgcccatgtgtgctttatgtaaatggcctctgctctgagattgagtagctcttacaagatggtgggaggctgaaataacagagaactaggaagcctgaaaactctctctgggccctgttcttttaaagcccctttgctttgtaaccttggcctgatcacttccatctcagaacttcagtctccttaactgccaaatcaagtggatgttcaaagacctgtcagacccttacagatgaaccagctgtgtccatccatcatgttcatcagctgctctcaacccatagagatcacatgaggtttcgagatttcagggtctttaacatcaatttataatttaaaaaatttttttcattacataaataaaatgtgtttattttagaaaatttagcaattatagaaaccaaaaagaaaatgcacattccctgtaattttactgctcagacataagaaagttgacatatttgtcttatttccatagatataaatacttttaccctcaaaaaaatggatcatacatgtcagtatgttacctgtggtttttcacaaacattttatcatgaccatttttctgtcgtgaaatgtttttctgcattatttttagtggatgcatacttaaccaatttccctaaaattggacattcatgttgttttcagtggaatgttgttacttaatacctatgaatgaagaccctggcagccaaatttttaatgtaaggaaattatggctgtacacatatttttagaagtacaattgcttaggccaaagtggaggtaaaattataagtaatttgatccacactggccaagcaagtatgtctcattatattttattttttgagacagggtctcaccttttcacccaggctggagtacaatggcacaatcttggctcactgcaacctctgcctccctggctcaagcaatcctcccacgtcagcctcccaagtagctgggaatacaggcacaccctaccatgcccagctaatttttttgtgtttgtttgtttgtttgtttgtttttagtagagacgaggtttcaccatgttgctcaggcttgtcttgaactcctgagctcaagcaatccactcacattggcctccaaagtactgggattacaggcatgagccactgcatctggccttatttttaaattgtaagatgaattaagataaggtaaaactgagaagttgagatgttgtggagaaagcaatgataccatgagctcttgggtaaacggagacattagaccgggtgaatattaggtttctctccaaatctgtagttttaggtgtgtttgagttgttactagctttgtctttttcttccttcctccccttaaccaacccttctgagaaacatcttacacagtaagctctttaagcgaattctttttttctttttttttttttttttgagacggagtctcgctttgttgcccaggctggagtgcagtggtgcaatctcagctcactgcaagctctgcctcccgggttcaggccattttcctgcctcagcctcccaaatagctgggactacatctttaagttaattctaaggaaagagactgtctgcttggagagacaagtcctgtaaatatatttgtttcatgtgtgtgagacttgtctaagagctgaatatattttacgaatcttaatgggcaaataactatagagaagttttgtttgtttggttggtttaatttgctttggtttgggttggacccaaaatgtaaactctaaaaaggatggggcactttattcagtgggtggagtcaacttgcaaaggtgctaatcaaagacagtctctaaaaaaatgtaccgctaaaaatgtcactgttagttactgtaaatagaaagaaacaaggagagtattaagccaggtcttgtccctggtcactggagacaagcaggaaaccttaaatgaagatgcagtcatttgtttcagtagaaaatcaggccagcatgaatcatttcaccgcgaagagaatggagatttttctcagttgttgtactagttgggacattttggcacaagtgaaatccaatgcaaaaaggcttaagtaaaaacagagacatataactggaatgtctctggttttaggcacatttgtgtgcaggaacttgaacaatgacagagctctatctcattctctccacctcttggttcatttgccctgttttcattcaccccatggtgggctaactgcttgccagtagccccacacctgcagactcctgactttgcaaccacagaacctttaccatcttttacataatgtcctggggagaatacggacaggccctagattgaggaggacagactcatctctaaactgatgatgtggccaggattatgcaggaccatcagcggccctgtgaagtcaggatgcctggcttcatgttgccacttctgtttccagggtgggggcggagtttcttccctgcacccccaacaaacactgtggaatgggtttcttatgcatagaaggagttaaaaaggaacagaaaacagcagatatcaactatcctggttctgctgctaactggttctgtgaccttggatataataacttctccattctaagcctcagtttcttcatttgaagaatggaggaattgattagaggattttgaaaactctcgtgtttctagcatagaatgattgctgaagaggcaaaagacaccttatggtttggctcaggagtcacagaattatctgtttatacagtttccaagcactgtcattaggctttgtgcgggggagtcacaaattggcaggggcatttccccgcttccctccttgacactgacctccagcaccttgttgggggctacctctaccctgttggggtggcctttggggagtttcaggagaagctgctgccttggtaaataatcttttttttattgagtaaacatggtcagctgcctggccttcctgactctggattctagcttcataggaagccactgaaaactactgtgaaaaaatattacaaggttaaactgaggtttttcctttggctggatttttcttgcagtcatttccaaaaacctgtttcccaaatcaacctggtgtgtgtggattttcttcccctacaagttagaaagcaattgtgcttctatacatggaattttctttacttcagctgctgaagcattcgttggaatacatactgcaaaaatgactgctgtggctattaccgtagttgctcaggggagctattcagatgcctcatttattggagcttaatagattaaaagtccaaattgagtctcatgatataagcctaatcaagttctaatctgcataattttcccataagcagcaatgggaaatttggataatttatgtttcagcagttgccaatcatgtgttaaatagcattgttgcatttacttatcaaaatatttttattgatctgcacttcatctgacatttgcctttgaggtttttttccctggcattaacaggaaatttaattcatctcatagatgatgtaatatgagatgtttctcttgattttaacatgtctttatagatcatttttaaaggtgatctttcccttttacaacttcatattgaatacctgtctcagcaaacctagatgactcggcctaatttatttccctagtttaacgtagcatatggatttctaaccatcatttatatgcacacaataaaagataatttggcccaccatttgaaccaattcctttatgttaagtctatcggggtgggagaagcacttaccttcatttctccatctattctaggggagatgattgataagaatttccatctccctctctccctggaaaggctcagggatttaactagggaagatttagaaagtactttgtgtttcccccatggaaaagtactgtaataaagcatttattatatgtactgagttgtgcatgctgccataccaaagcaagttaagcataactacaatgggtcccagttgttatctgctattgtttaaaagtgaaaacaataaaaagtaagactggctcaggcctcagacttgcctgccagggacagtacctagaaggagaaggccagcacccaagtcagggatgcggcacagcctgcaggtgtcaggagtctgaggtcagactgcctggctgcggctcccagggacacttaccaattgggtatgcttgagccagttatgccactgctctgaatcttattttcctcttctacaaaatgcaaatatcaacagtccctaaacacacagggactgttatgaggaataaacaaggtggcccatgaaaaaacccttagcccagcctggcacataagaagcaatatggcgtggtggcttagaggagacactgggacttgtttatctgggttccactctgagatctgctaattcctagatgtatgtcctggggcaagttgcttaccttctctgtgcttcagtttcctcctctgaaaaatagtagtatatacataggatggttctgagaaccaaagttattacgtgagcaaaattcagtacatagtaagcactcagtaagtgttggctattttttttctttgggttctagttcagccttccccctctcttcttcattctcaattattaaccagtttaggtctagagtattcttgcctttgctttgagtctcataaaaacaatgccattgagcctttctcattttctaatgcacttgggtttacagtgtcctggaacccttttccagccattacttgtgtatatcttgtctgagccatagtccttctttccttatgatcacataaggaatattgtgtatatatatatatatatatatatatatatatatatatatatatatacacacacacacacacacacacacacacacacaatgctcattgccttctcattagtattctaggattttctgtgtgtgaaaaatcttttttaagaatctactaaatacttcttcagttctttatccatagggaaggggaagtgatccacgaatacttattgtatacctaataaaatattaatattggtagccagcattttttagcacttgcctcataccagatattgtactaaatgttttaaatacattattttattttatccttacaattgtcctatgtgggaggtatttgtggtttatcgatgaagaagcagactaggagagagtctgcacaatgcttatagtgccatggcttataggtggaggtgccagaatttgaatccaggacacctgactttacagcccatgctgttaacaatttcattctatttcttttctatgtgctgggcattttgtagataatctgggaagttcaaagaaatgaaaatccagtctctgacctaaagttcttatacagtatatagaatgagaatatctgtcataggataaagttggtcaagcacttatgtctcatgctgaatgaataaaataggtaacaaaaacctgccacaccagccactgaagattggagtggggagaaaacttacagtgtaaggagttcaggtggtctttggaagttatttattttatttttattgtttccagaagttattggggtattggggtacaggtggtgtttggttgcatgagtaagttctttagtggtgatctgtgagattttggtgcatccttcacccaagcagtatacactgccccatatttgtagtcttttatccctcgtctccctcccactcttaacccctaagtccctgaagtctgttgtatcattcttatgcctttgcatctccatagcatagctcccacataccagtgagaacatatgatgtttggttttccattcctgagttacatcacttagaataatagtctccagtctcatccaggtcactgcaaatgctgttaattaattcctttgtatggctgtgtagtattcactcacatatatatgtgtgtgtgtgtgtgtgtgtgtgtgtgtgtgtgatgtgatatatatatgtgtgtgtgtatatatatatatatctcacagtttctttatcctctcattgattaatgggcatttgggttagttccatggttttgcaattgtgaattgtgctgctataaacattcgtgtgcaagtatctttttcgaataatgacttcttttcctctgggtagataaccagtggtgggattgctggataaaatggtagatctacttttagttctttgaggaatctccacactgttttccatagtggctgtagtagtttacattgccgccagcagtgtagaggtgttctctgttcaccgcatccatgccaacatctactgtttcttgatattttgattatggccattcttgcaggaataaggtggtatcacattgtgttttgatttgcattttcctgatacttagtgatgttatatacaaatggccaacaaacatatggaagtcatttttagcacaaaacttgcctcccatggccatgatcaacaaagtgctatggggacatggctaaagaatcaggagcccatctggtgatagctttggctgtggatgatttaaacttcagtcttttcctgattgaggacttctcattccatgtctctaatggtgatattcttagtcatcttttctggcaaaataagtggttgtttctaaaattaacttcccaagtgttagtttaactaatgaagggagtgtttcccagtttcactgttctctagctgtagatctctggagtatattccatgtgccagtgtgttcacatgcagaactagggcgttgtttaatgtagagagacttcaggtgctacccatgatatagtcatggctgcaagcaataatgggaaggagagcaagatggtcagagattgggccacaatttagacctgcccctttatcaaatgcagctatgaggaatgcggtggacaccatcctatggcatcaaaggccggattgcctcattcctttatggaaggtgcttgaatttctcttctctccaaagccatttaaggaatctggggcaatcctgccgtttctgaccataattttcccatatcagtacccctaagaaagaaacaatgctaataaattatgttcacctttaacataactctacaccagggaaaaagaagaagccaactttgctgttattgttgccttttgcttttaaaaatgtgtgactagaaaagtagggaaacaaaaagaggcatgaagttttcttagcaataaaagcacacttttttggggagtcatgcataggggagagttgggccttcaacagagagatgtctttggacacctaccatagtttgtcagttgcagatgctaatggaaccaggcctggtgactgaaggggaaaatggaatatgaaagcaaaatgaaagaagcctatgaagcaagcatgtcatttccaaatgaaggtttcatgcaaaggaattgagtcttttcacagctgaaaatggaatctttaaataagataaaataaaaggatgccgtggcttgttgcgagttctgtaatgaaatacagttttcctaataccgtgtgacctgcatttctccctgctttatgggtgctattccttgacgtacaaacccgtattttctcaagtcagcatttgatgatggatgtcaaaatacaggccatgtattatgcatatagcattaccgatttaaggtgtttacttgtcaagttgaagaaattcaaaaacgtcacatccactgaatctgcacagctgtcacttccagtttttcatgtttttgaatgaaacttctaatgaaaacagtttagttttccccttcaccatcctagaagaagaaaacagctagcatttaaaaatgcgtgtttttggttatgtggttggctgaaaaacatatattcgaaagtttgaaaagatggacactacaatgtcaatcaaaatgacttacccttttcatagtgtattaatgtaaagaatcaatttaagtgcagtcagggaatggatattaagtaaaactttgtctttctttttgaaagtatggcactcagtgataagaaatgtatacacgggagagcagaaagtaagaaaacccttttatatttctctggcattttatgcattatgcacctccaaaacaacaggcaattattgagctcccgtatttcattcctgactcacacctagccaaaatgccagactcaacacaatcttgtcacattgctggaaagtgagtcagatatctggtcacataataatctatttggagttttatccttggaaatttagcaagtgactttgttcctaaaagtccctaattcattggtaagcccatgtagcattccgctgaaggaaaaaaggagaaaccgaagtgagtgtgaatgcttgcctatcatctaaatgtaattgcactgggtcttgccacttgcgtggagctgccgtatgcttcgttagaaaaattaatttttaccagatgaatgtaggaagtaaataggtttctaatattgatatgtgtccatgcaaaaccttaacgaggcagacattctgcctagccgggatatttctcactctcactaaactgaaagttacagttgttccaacctcatccaggtatgtacttggcttggacctgggacccaaagaagcccaaactgcaaaatcagagaccaagcaggctgctttccaattttcctgtgtccacatataccttatgtggtctgtgtttggcacactgggaagttcaagggatcagccataagcaggtggcatatacattagtcaggaggatttagatgcaagtaaactccttctccatttagcttaaacagaaagaaaaaaatgtgaacatcttattatattgtgtgtatgtatatgtataaatacatttgtgtatgtgtgtgtgtgtgtgtgtgtgtgtgtgtttatgtgtataaaatctcacatagggagaaatcctgaggtgggatggctccaggctgcttgccccaggaactccaggacagctcttcctgtcattcacttgagccaatatcactaagttagttatgccctcagctggtgcctcagttcctggcactacaggcacataaaaccgtgctcagtaaattaaaagagaatctcttcctatgtgtttctttttaagagcaaggaaacacttcctgaaagccccaggaagatttcctgacacctcccattggccagaactctgtgaaaactgaggcctaagtcactcaccagcaagaggataagcaattgattggtttacggtaacagtcaggccaggttaggttatgttgtggtaacaacaacaacaaacaaacaaacaaacaaatctcagcggcttaaagcaacacagctttattcttgactcactcagtatgctttgtgggtctgggtaactgtccagggctgttgtctagccttcatctccatagtaacctgtattctcacagttgccatggcctgggaagagagagatggctgtccaatacctgaaccagcagtgatatgcactgctctgctcacttttcatgggccagagcatttcatgtgtcacatggccatacctaacttcaagggggcacaggggataattctcctgtgtccctggaaagagatgggagccaagatctatgagcagaataaataattggtatgaagtctggattttttagggaactatgaagtgagttacgattatttataatggtttcctaccctgtccttctaaagaattaatcatcagagtttatcccgggaatactaattgttgacctgtgaataatgcataagctacatttttggggttgtatgtatatagtgtactctgattatttccaaattttctacttctctgatttttcttcctcctctgtttccttcccactagggttcacacctccaggaatggatagatcctctccagataacagcccagtgcacgggatgttacgtcaaccatccatcacaactggggtcaacatccccatcatcactgaactaggtaggggtcaatgtcagctttggggggagtttttgttctgtctttcaaaccatacaggatatgaggaggttggtttatttcttagccctttcaactttgtagctgctatggggtttgttttgagggggctgggaggaaggtatggggagaaatatggcagattaccggaagggaaaactgatctatctttcttctgagatgaatagacagtttccttcatgctggtcactgttttcaaaggagcatgagatgatggatttgcgattggggcattcaattgggaatggagaggaaaggaggaaaggcttagttcacggattctttctggtgatttttactgtaagaacctcttttgagcattctgtctggacagctcctacaatctgagtcctccactgatatacaaagcctcggatctaagccaaacccattttgggaacaaggtagaagccctgggctaatgtgtaataacttgacatttaacgtatcgtagttgaatatctcagccaaaagccattttcagcaaatgccattctggcccccaaaatgatggggttttgagggccatgttggttggacaatagaatctaacttctaacctggccatggcactccctgttaccattagtgagtgtgcaaaactgtagagtggcctcttcccccaagacaaatgcaaactacctgtggtccggggtccctttacttgagaatgtttcctctgttattccctcactctcttctttttctgtactttcctccactccctttccccaacccttaaatgctgtatccaattagctaaaccgggcaagttgcctttggtatcagtcaatcaggaaaaaaacagtgggacgcacattctaatgataactgaactgggtaagaagcactgttttccttcacatcagtatctccttttgttctgttgttggtgtttccaactatcatcagcttgtttttatttcaccggctgtaacagaaaggctaccccatggcactgctttgaatgtgttttatttgtggctctggttggaatcgactgtcttgttctggactttcttaatgattttttccccacacagcatcagtaaacctttgatcacacccatctgacctggcagttgtttccaaagcatctttgctctaattcattttctctggcctgagccttttttccccacttttttttgtcaccccgctctcccgccttctcccttctactcctcttccaacatactgtcagtttgaatgacatgtcttcacagctcttagaggaagtcaaaggagaatatcaaaattttaagataagaaacctaagatggcactttccctccagctgtttatttttctttattctgactttatttgcctttttttttttttccccctactagggcatttctcagaagctctggttctgaagccataaaaacacctggtccctaggagaactttttttactaaaggcagatttcaagaagggtgcggaggataaggttagcagccacccacgtgcagccctgcactctggcccccaatcccagcccagaatcctctctgggagattcacaatggactcaggtggacgataaaggcctccagtcgtgactgcatttgttaggttcttccccacttccccgtgacttggttaataactccatgaagggcacccatcagcagcaagtctcagaactggggattgatcttctaaatagagacagcaaaagtgctgctcagcagaggggtggatagagaggtgggagcacctgccttcacatgactcacaaatgaaatgaacactccattttcttggcccaaaaatatatttcaaaataagggagcaggctttcaacacagtaatcttgcttgcgagatgtctagaaaccaaggaataaattgtccaccactcagcagtgcattattgtaggtatagctatttatcaggacaaattcactcaggtcagggagtatcacactattttctgtttccaaccataggaggggtatctttttcatgtttagtgtagttgtttaaaagccctaggtttctggattgctctcctcagaactggagggcaataagagacccagggctcatgtggtccacgcctctggttggaaaattaatccaaacatctccatctcacaaacctacagcagcatttcagaatcctcactgccgggaatttcattttctatttggaattcacgtgccgctgactaactaggatatcttaatttgtcattagtagacgagaaaaggaaaagcttggtgccccaaacctaaggcaacaattctggtatttgattagcatcattgactctcctgaagcctttgtcccacaccagatttcttccttgtgttcagagaatctttcaggtgctcacaccacccttgtcttctgccttgaaacctatttctctagccactataccaccctcctcagaccacttcacctcccacatcccccacaaatacttcttatttatctacatgttctgagatgtgttctgcattatgccaggccagtataatgaattttaagagacacagagggcaccaaggccacacaagctttcaaagctgtgtagcacattccacttttcatctacttggagactctcaattgatgttagcatggcaaaggctcctcagagtctcacaagaaaggactgtgttacagctgtttcacctgactattccaattgtatttgaccacatatgctttggggtgattacgtgggtacctcttagcacccacataattactgttctgtgaaataggccttgagtagcattgcttgctctccttctgagactgggtatttcagaacggtatacaaggtattcactggaccctggctggtctcttggagcgcttttcctatgaccccagatgtctagctcactggcaatcgggagtcccctccccctacttggagtcacttcacctccatatctggtaccaacccttccccatcttcctgataagaggtaacagatgctgtgcttttcggagcattgccacacacaccattggtggctattacaagtaactaaaaccacattcttccatatgtcgtctccagtttacattttctgattcacaaaacagaaagactaaacagtggcctacaacatccctttggacaagtgaagggaggtgaggaaaagctacctcttgaaagacccctgagcaagaccttcagtgtttccaagagaggcagagggaagctgggtattttcatgctataatgggtggacaggtatttaatgtcagaagggagatcatgacagcagctggtatttatcaagtcatggcatgatccagatgctgggccaggcttactgggcaccatcccattcgtatgagcctcctgacagcctcatgagagagctgctgtaactcccccattttacagaaacaaactaaggtatagaatgatgaaatgctttgcccaaggaagttggcagcacaggctggactgaagcccagttgtcagagcctggattttggactttcaccactagcctgcaattcaattgctgcttaaacaatggggacccaaatgtgaccaattttggaagaacagagcaaagattttccccattagaatttttctctggggaaacaagatgatgtcattttaaaatactaattccatgcctagcctttcatgctagtatcatttattctgcttcatacagtaaacaaaagttttttttttttaaaaaagaagagttatcaagaaagttgcttaaaaattaaaacaatcactctagaaaaaagaattagctgttgatacatttagaaaggaatcagggaaaggaaacctcatctgttctcttcctaaaatcacaataattatttcagaaattttgagtgcccccttctcccatccccccaccgacttttcccctattacttgctctgcaaaactgataatttccaaagccaagatgggaatggaaattaatttgtcatttaatttttaataagttaaagacatctgagtgacacaactaatcagcctgcacgtacatgcgggaggagtccttgaggaatcctcagatggaaatgaaatacagcatccaatgctgcatctgcttgaatgcaagcatataaaagattgagctgtttaggatgggaaagggagaacgtgggcgtccccatgcaactcaaaattcagagcaagtccttgtcagcaagcagcaggagacagccaggcatccatcccacctggggtttcctgtgtattaaacagggcctattgggtgtggacctagatttagggcctgggaccccgggaactacccaggccaatcccagtgggtaggctgcgggttatgcctgtggctgaattccttgctatctgcctttgctgtgctccccttccagcgctctttactcccaataagctgctttcttttcattgtggctaaaatgactatcccagcatggctgctcatcattgaaatatgtccatctctcaaaggacttggttaccaaaaaacactggaaagtgtttttaggtcatgatcctaaagctatgccaaaggactggccagcacagtctattggtcctccagtggcctgccgtggagcaagcctgcttgaacttattgctctccaggtctcagacacttaaacagtgacacaggaacagtccattgagtcccactgccccccttacccaaagatccatctacagcttattccatgcttttgtttccttctcaatgacttcagtatttctaaaccagtagcctggtctccctctggcttcaatgcctgtgtgtggtcttcagagctaattcttattttatgctttttctagtgaacgatactaatgttcagtttttggaccaagacgatgatgatgaccctgatacagaactgtacctcacgcagccctttgcctgtgggacagcatttgccgtcagtgtcctggactcactcatgagcgcggtgagttatcctgttccctcctcctcactcaagggtggaggatgtgccaatagagcacctccaacctttgaggccctgggctgcactggggccacagtggagagcaagactcctagaagctcacaccttagaaggggagacccacattataaaaccatcacacaagtaaatgtttgattataaattcctcaagtgcaaggaaggcaaggcaggctagaaggaaatataggtgagggcttgacctggttttggggatcccagaaaaattccccaagggagttgtacattttatgctaaaatttgagccataaagaggggagatcttgggggaagagcattctctgaagaagaaagaaagcaaatgcaaaacctggtgttgggggggacctgaggctctcaaagaaggcaaagaaaccctgtgaggctggaccatggggagacaagggtgcaggaggatggccaaggttagacctgcagaaccttgaaacacattttcatggttttggactttttcttaagaataatgaagaggcactgaaggattttagttggagagtgacataatcaggttcatgctttaaggggattgccttggctgttgtagggaggatgattcagaggtacaagatggcggcaggaggtctgagtaagaggctgtcatggcttggactaggatagagctggtgttgggatcgagggaggtggatggagctcagtggtattgggcagtacaattaataggacttgggaaaagattgagcatgagcagaaggtggagaggacagtgggtcaaagatgactgccaggcctgtcactgagactgaagtccttgggagagaaccaggcatggaggcaaggcctggctggaaggagggaggagttagtggcagagagaggacagtgggctggcccagggatcaaacacagctttggtttcttttataacttgatgtgcatctagcaatcaggcatttgttttttcacttttgcaaccgaaaaacaaataacgattaaaaaatgggtcccaacattatggagccatctttcactgcaaaaggcaaaagtaggcatttagaatgagtcataacctgggtattatgaagtcttcccactgagcatctttatttattatgtagaaaatcttcttcattttggagttctcaaattctcaatttgtgaaaatgcagacataggctgaacaaaaacttgacctttggagaatccatgataaagagcttttctgaacacattaaaaccataaacagaactcagagtttttacacacgtatatttcttaaagtgctgaaagttattctcctgaatgtgctaaacaactgatatgctaattatgtactggtctcatctattcattaaataatgctaatcccagaaggacctctatttgaggaaagaaaaaacataaagctttttaagactaatttgggttattctgtatgcctgaacattgtccaactgcaagcatatcttatttaaaaatcagaattttggatttaaaaatgactgtgaaatgacattcgtctgaattaaggttaactgggcttcatgccatgccatggctttccaagccaacaaggagataaaatggtccttggaaaagggctcccttggtttcctggggctcatgatctttcttatggcctgatgataccaaggctaacctttctacctgctagtgatgttgggctcagtttgggcaaactccttgagcaagccagaaggaatgatagaagcctcaagatgtgttcctaagaagaccatattctcagtcataggcctcatattctgcaaatccagtttcaaatggattttggtaattcatctcattagaaatttttattttagttctgatcctaattacagagatctcagaagactgttctaagagctggttaaactatttacagtagaatttttttttcagaactacaaaatactctgataacatttttaaaattccaaatttataaaattgtttatgtttctacatatcagatatttagtatgtttctagcaggactggctacataatttgcaaggtcacttttcatgaattattaagaatttcaaaatggtgacagcagagtattaaaacaaaagagacttggggctgggtgcggtggctaccgcttgtaacccagcactttagaaggccgaggtgggcagatcacttgagcccaggagtttgagaccagcctgggcaacatggcaaaaccctgtctctactaaaaatataaaaaaattagctgggtgtggtggtgtgcacctgtaatcccagctacttgggaggctgaggcctgagaatcgcttgagcctgggaggtggaggttgctgtgagatgatatagcgccactgcactccagcctgggtgacagaatgagaccctgtctcaaaaaataaaataaaataaaataaaacaacagagatgtgtctgagtacagccctgtgcaaccacataggctgaacacccatgaaaccagccctggttccaaggaataaaatcggtttgagcactggagaacttcttttcaacacagccaaaggggcatatggtagccacagggtggaggtgggggcccatctggatttgagttgcacaagcatctatatcatcagtaggtagtcagttcttggaaattcaaatgagaattcaaagtgaattgatttgaaatttttaaacaagccatctctcatctcctttgaaatgcacacaaaaatgtttgggatagtgtgactaaggcatgtttggatgcaatagtatgggagcagcatgtcttctgcattctagcctaggataaaagggtatcaggaatctggtaactgtcattgtatttatcatcaggagcatcatttactaagggcccagaactgtgcgaggcactttagctacactatcgaatcttttggacaataatgtgaatactcttggtttaagtgttgaagcaagacatatttaagtaagtcattgatggtaacttttcaaatcattaatcaaaatgcctatcaaattattccaggtcttgttttcattgtctaggatgaacaagcttcataatgaggtcttgagtagggtctgagtccacaaatctagttggatccagacgttttggtaaaatgttacctgtgatttctttgcattctaccccaaccttaatgtatgaaaaaacagattagtcaagtgccaaggcagtaactagaaggaacaaaaagggctgtcatgaatataaattgagaaagtgagactcctccaaacagcaggagacagaggtaaactttcattgcaggcattcactcataagcaacatcacaacatccacacacaaatctcttcagctgttgacagtctccttattctagcgctcctccccaaattgtcatttaatcatgtgtctaaacattctctgaatattgtccttcataacccaactcctgctgcttactgcttcatttgttaaaagaataatattttgattcatcacaggcattcctggaacagatcaggatgttacagacatggccctgtggctttatctcacaaatcaacagcagaaacacaggatgagagggaataattaggtttttggatatatgtctctaagaagatcacaacttagaaatgtatttttcagaatgataccatcttgatgcacacagtcgcaccaggtgaaaggaatcctctctgtttttagggatgagactcacatatgagtattcagatttctttttcatccagctatcactttctcccaaccccagccccaacttaagctccacttggaccctgaaaagtgaatactggacatggactcaagcgccagatggcttagatctggattccagaactgctgtttactggctgggtaaccttaacctccctgtgcctcagttttctcatctttaaaatgaagatagtaatagtacctatgtcacagggttgcagagatgagtaaatgggtaaaggttgtaaagcgattagagcggtgcttagcacttgacaagctctgtatgtatttattgttgctagtgtttttaatcaatacatttattgggcacttactggacaccaggcatgattccccatgctgcggattcagttgtaaaaaagaaggatgaagaccttgccttcatgttatttaaactttcattctagtgggttaagagtaaataggtaagtgaataaatgaatagtgtcacataaggataattgatttgaagaacatgaaatagcttgaatgggtgtggagacctgttttaccctcagtggtcagagtaaaattatcctaggaggtaacattgaagctgacactgaaaaaaacagagggagagaacactataaaggccaaagctgcacagtggtgacaagctgggtttggtttgttggaggaagcagttggaggccattatggttggaatgtggtagacaggaaggcaatcaagaaggcaaggccgctggccacactgagtattccgagtacaatagaccacatctggccaagttctaagtctggaatgagacacttcagacttggcgagaggatcctccttcttctgaaagccaccagcttcctcctaatgccactgtttctggatacgctggctaggacagtgagctcatcactgagttgattcctgaagcgcaacccttgattatttttttgtccaacaccccatcctcatgcactcattttagaagaagaaatagcacaatatattggcatagtacttggcttgatatcttgtttctaataaaagatctgtaatagaagtctcgaaatgtcacattgcagtctacatctaccccacagacaacttctgcatttatcaagtttttatttttaaattgaatttgttgccaatattttaaaataagattttatataaaatcggggttcctgccttctttaaattagagtcagaaggcagagtcccagattcccgtaaagcagctattggcttgagctgagcagctgctccctttagccacagtccacactactctctattgtatcccaccaggcctgcttcattcatgtcccttccctgcttggttcatcccactgtcctggccttaccagcttcctgcgttttgcttctaatcttatgtgtctgcattgcaatgtctgtggtcagacagcatccttggccttccggtcacttgcttgtcctctgagttaggaggttgtgcacatgatgtccattttccttgagccttggacctttcctaaacagataccaatcacactgaaccatcgttattgaaggagcagtgaggagccacctccttctgaggagaaaaaggggaaccctactacaagagctaatgagttccaatgcacacaagttgggagtgttgtcgttttttttttagaaaacaagatttaatgaagctttaggtttgcagggcctacctaatctggaaaaataaagaaaaagcatattataacagtgttaagagaaagagcagagaaaagcagaggccccttttgctagtgtacgatacatctgagaagcgtgaatgccagcctatggagagacccatgcgcaggatcccccaggagctagagagaaatttcaatgtgagccagttaaggcaggtgtgtctttgctctgcccactgcaccacaatgcccagggcaggagtttgcatgtccagtgcattcatattttcagaacaaaggcagtgacttggaggagggaaactgggccatgaattaggacttgtagcttctggtcctggctcaccggcagcccttgcacattttttctactgttaaatgggaatgatgttactccttatgactttctgctaatcggagaatggcaaaggcatataaaaatctttcacagagcagatacgtatttcttaagatcacatgtaattacaaagaagcagatttttttggtatatatgcatgtacatatatgtatatatatttatgtgtttgtgtgcacttatcctctctctttctctctttcatgaacacacatcttaaataatatttgggagcttagtgggtagatgagttggggtacccagaagatatgattccatgttctcatctttaatatcagagagctggcctgtttgccagaaacgaagttatatcagtaagactggagggtgtgaccgtctggaatgtgggttcacatgatttactgtctttcctgtactttcattaagggccaaacccttgaacctggtgttatggagaggcctgagttctctatcagtccaagctaacctaatgccatgtgattttagttacataaacaatttattgctccataaccctatttcttacactccactcaagagcctccatttcaactgctcacacggagacagagggcacatggccgtcccgaggcagaggagctagcagtggtgtcagtcgggtacatggaggtatgtcctgctagactcaggacagaccactgctgtcacatcaggccaggcaggcctggggtagggaaaaaaaaatccaatcattttcatccctcacgaaagaaaaatactaaaaataaaaatctacaccatgaaaactagcaaatataaaaaatggcagctatgacatggaaaatgacaattttagagcaattataaacgaaaggcagagagccattaaagttaaggcaatgttattaaaagatgtgttaattttcagttaaattttctataaaagaccaattagtttaaaaggcttgacagcattaactgtgaaacataagctccggtaattatactttaaaaaaataaaaagaggaggatgcttgggcgggttacacttgcaggcacagcggggcgtgggccaagcgggctagatggcgctgtgggctcaggtttccctgttacagtgccttggtccctcccctggcatttcatggtttcctcagtgtccttttacaggacctgagaatcatcaaactttagaggccaagcgggccacccttgtgttctgagccagctctcagagattagaatcagaacgccgagacacccggagagggaattgtctaaattggttgcattgctagttgatggttctttttataaactcccattttttgagtatgctttgtctatcagaagtttcacaaatcctctcatttaactctaatctataaatttttgttttgttttgttttttcatctctgttatatggatgaggaattcaaggcagagaaaagttaggcaactttttcattgttgtgcctattggatagcaaagcaggtattaaaagccacactaattggatttggaaatctgtactcataaccagggggccacgttgccttaatcagaagaagggcttcgctagtcaggtttgcaaacttgtccttggcagtgggaagagggactcctgtattccttagactatgcgggttccctgatcccaggctctgaacaggaccctaactcagctgtcttatactcaatgcccatgtgacgcaaggatagatattgagaaggtctctgcctgaagcatccctgaagactaaccctgccagagttggaggttctatacaagagcttcccagaagacttctagcacaggtatcatggtaaggcacagaaaagactggcaggacaaaagcttaggaggcaaaggatctcacctacatgatcctgcctttagaatgtttcatttcttcaattttagcatttatgttaacccagaaaaaaatgtgtgccttctgggtcaggtgagttgtagagaggtttcctccgcaggaagcgcctttggtaattggcatttgaagttctagcacctggtttgccccatgatgcagaaacagccatcacctatgcagaaagccttggagtgatgcttaattgcagactgctgaatgctccgtgaagtgccctaccccaaccctcactcccatcacataaggaaatttgcatcctccaatatgactgacctgacacccttttccagaaaaggcattgtctttccaccaaattattcagatcctgaagagataggtgtgcagagcacacccgtcagcaatgctcagagtccttttctgcatccgaatattggggtatcaaaacaggagcaaaagcatctgctggcaaaaatacatcatcattctctgtcatcacagattctgctgccccacagctctgctcctggatgcctgcatggaaaaatcaaggagagccatcatctgggatgcagtgccagctcagagagcagacaattatgctcagagatatgagtggtcccagagttgttcagacacctgtgaaaccctgggactgactatgaaattgtacctgttgatgagcaattctaaaagtcatgcactctttgactttcacacaatttcaggctaaaccaaggcccaacgattagtaggtgctcaataaatgtcagtgactgatcaaaaagatttgggtataactgatttcaacacagaagtgggaacatgttagggtcaaatcccaaagatttgacaaaacaataacctcccagcctgaccttctagatttatcattgcaatggataacctatagtgccctttgtttaaaaaaaattgactgtgtttttattagaacagttattcatacttcttgatgaaaatttggaaagcacagaaacatataaaagaagacatataaagaagaaacatataaaaataaaaagaaaacatataaagaagaaaatataaatggcctatgtttccaacaccaaggataagcatggttaatattttggtgtctttccttctaaatggatggataaatacagaattatctcattttataggttggttattttttcccttttcagttaatattttatccagagtattttattatttccttaggtgtcatgatttgcagagcctccataggactttatgagactccagtctgtggatgttccagaatcgatttatcactaaatttttggctatttagctttaaaaaatttttgttatagcaatgattaatcctgtaataaaaattattgtacataaatctttgaacaagtagcaacttattatattgaggcaaatgtactgggtttttttttttttaacaaatagggacattttaaaatttcttgatacatattgtcatgatatctccaagaaacaattttaccaatccacactctcgtcatactgagccatctcatacattatggcaaatgccgattgtcatttttcctaggaggccctttaattgtgtttatgatagttttgaagcatatcagtttttaatctgtatataatgatgtaaatacatattttatatagtgaattcagtttttatgcataaaaagtgcatgctgaacatgagaactatcaagcatcttgagattaaacagtttgctatatttttgtgaagttgtttgtggctacattttttgcctttaactatttagtaacatttactttcttttttacagaaatttaaaataaatgtattttcacagcagaaaatatataaaataaaattataggaaaaaaaccccaaattctaaaaccaagaattaactactaagtagaaattttgtgtactacttacagttactttcacataaatacgtctatcagttcaggtatgcattatttttccctctggaagtccccaaatcagagcattatgtactttttgtaatactttatggtagaaataaatgagtgaccataataataaacaggatatcattttctgataactttccattaaacattgaagatttatatttaaaaaataattcaaaaagtaataagtgcatgatttgttatattatgaaacagtgtacattataaagtttaataataaaaatgatctctacattttataaacatatgataattgaaaacattaaaaggaatcattagtatgaaaaagccaattaaaagtaatattaaaacttaaaacccagtaccataaagattcaatatttaaaagtgggtactcttaaaattaaattttaaatacagaaaaagttaatttccctagccaatagttttgcaggtatgcatttttaacatgaattgtgattcatggtgttttggggatcctacttttaaaaaacattttagtattatataattattaccatgccattaaatattatctgaaagcacaatattcatgtctgtacaatatgagtcatgtcaaagaaccattgtttaatcattaccatattgttgaaaaatttttatcagagagccagtttcccccaaatcattcattgagtaaaatcccttccctgtggtatgcaatgctttccttgttatactaaggaatggatcagcaaactgtcttgtaaagagccagatggtaaatattttcagcctttgagggccacatagtctctgtcacaactacttaactctgagtttgttagcaccaaagcagccccagacaatacataaacaaatggacatggctgggtcccaacaaaaccttattttaaaaaagtaatggatggcagagcaagatttggcccaagagccagatttgccaacttttgtattaaggtcttataactactaagctatggttctcataaatccattctggttgatcttctaatttttcacattgtctacaatatttggttaggaaacctttaaaatttactatactacatgagaggacaattttgtacaactctttccaggggaaatttagcataattttatcaagttttaaaaagtccaattcaaatctgcaattacacatatgtcaaacaacaattttactggaaaaaatgacattaaatggcctatttacatgttaaggaacatggaattttccttttttcctaatactctcctctgtctcttcatagatgattactactttgctttttgcctaaaaacagtagcgattcttattcacgtccagtgattggtattaaagagagtatctggaataatactgttaattctcctatgtatctgacattttattctccttatttctaattttatttgtgttttttcagttatattgtcataagtttattttttcaaggaattatttcttgaatttaacaattcactaaatatcctcttgctaattcattaactgacacttttcatcctgcttttttttaaaaaaagaattcttttaatacttaattttacttattataattctgttgtatttaataatagcattaaaggctctgaatttgtctctatagcattggcctcaagacatgatatttttatatgtcattctcaaatattctttaattttaaaatatttcatattctaagtttgatttccatcttgacctagtagttataggatacttaacaaaatttttttgatgttctggaatatttacttttgcctctattacattgtatttaatttttaaaatgtaggttatacagcttatactttgttatatgtattgagatttgatggttttggccattgatttttttttttgtaatcgttgttacaaagtttagtaaaaatacactaaatcaacctgattatatcctcaattttcttatcttttgatctatttggcctgtaaaagctaaaaacagtgatagtgggaatatttcacgtattacccttagtccagatttattctagtgtaattctaattagttttgctttctatatttcagttataatatttgtccataaaaaattatagctttattgtgtcaactatgaatataaaattaacttatctaacataatagtttaaaatttttctttgaagctatactttttttcttccctttttctcttttaaagatatcagagtttgattttggcatttgaacaagtctgaaaatctttgccattttataggatcatttagctcatttatgtttagttatataacataagatgctatagtcttgcattatgttttttacatgcttctatcataattatatgttttatgatccatcttttggtatgtggactatattttgtatgcttattttctgtagtgtaaactttccattctatttttaactctagttagttgttaccagccattctatagatgtattttctaagtattattgtctagaaaaatttagtagttcttgattcctccttgtataagatcaggcaattttcatgcctttatttccatcatcatctctatctcatctcatttttctaactttaaaacataattttagcaatactatattaatagctagttttgtcatttttttaataattagttttgacatttgcattccattttgtaataatatatacaataatcttttacaattctgttttaaatatattttaacagtaaaccaaatttgctcatattttagttactaagggtttaaaattatctttaaagaagctaatttttgtttctaagtatttaaaaaaattaaatcaataaatgcttatgtacgcaaagagtcaaaaaatatttcagttgccttcacaaattattggcaatttaactatatgtagaatttttggaacaaatgtgtcctgtcaaaattcctttgacattcctcttacattttctagagaagcttcagcctagccttattttatacttgtatttcttacagcattgttttaggtcatttttattctccatttaatattttgaattcaaatattcaccgagtacaggtctaggagttggccacattaacttgctgaatgcttttgatctgcatcctagattcatttcccagctcaggacaggttatttttatttgtttgtttgcttgttttacatgcttgcattttgtttacaactttgatttgtaaatacttactgtttatcacttgacctttgttgtctttttctcaatatcaaccagcactcttattaaacaaacaaacaaaaatccctatatctttctctatttagcttagaacttcctggttttacttccgtatcactaattgtgtgtgtgtgtgtgtgtgtgtgtgtgtgtgtgtaattttcacctctaatactcatggctccttagattaaaaagttggccagtgcaaatttagttgtcttttaactatttattttaaaaaaatgagacacaacatactatacaactcatccatttaaagtgtacgattcagtggttttttttttagcatattcacagacatgtacagccatcactacagtcaattttagaacatgttcatggcatcaaaaagaaactttgtattttagttatcctaccctcccctacaactccacccatcaacccaccaaccctaagccaccactgatctactcattatttctgtagacatgccttttctggatattttatataaatagactcttgttgcaggaagtcagagaccccaaacggagggactggctgaagccttggcagaagaacataaattatgaagatttcatggacatttatcacttccccaatcagtactcttaataatttcctatgtctgtctttaatctcttaatcccatcatctttgtaagctgaggatgtatgtcgcctcaggaccctgtgatgattccgttaactgcacaaattttttctaaagcatgtgtgtttgaacaatatgaaatctgggcaccttaagaacaggataacagcaattttcagggaacaagggagataaccttaaagtctggctgcctgtgggctgggtggaacagagccatgtttctcttattactgaaaacaggtaagagaaatattgctgaattctttccccagtaaggaatattaataattaacaaccctgggaaaagaatgcattcccaggaggagcctctaaaatggctgctctgggggtgtctgccttatggagttgcagataagggatgaaacactccctggcctcctgcagcgcccccaggcttgctaggattaggaaattccagcccggcaaattctagtcagaccggttctctgctcttgaaccctgttaagatgattatcaatgacaacgcctgcacagcaggacatggaagttccttaataattctagttttgccctgaccttgtgatctcgccctgaccttttgccttgtgaccttttgttgcccttgaagcatgtgatctctgtgacccacaccctattcatacactccctcccctttgaaaattgctaataaaaacttgctggttttgcggctcagggggcatcatggaacccgccgacatgtgatgtctcccccagacacccagctttaaaatttctcccttttgtactctttccctttatttctcagactggccgacacttaaggaaatagaaacgaatgtacattgaattatcagaggtggtttgtctgatagactctcagtacaatgtgttcaaggttcatccatgttgtagcatgtatcattgcatcactcttttttacggccaaataatactcattgcacggatataatacattttgtgcatgcattcattagctaatggaaatttgggttattttcaccttttgggtattaccaataatgctgctataaacatctgtgtacacgttttcatatggacatatatttttatttatcttgggtatatactgtaagagtggaatttctgggtcatatagcaacacaatgttcaaacatatgaggaactgcctagctgttttccaaagtgactgtgtagcaggacgagctgcagacaaaactcctcagacaccgagttaaagaaggaagaggtttattcggccagcggcattggcaagactcctgtctcaagagccgagtatcccaagtgagcaattcctgtcccttttaagggctcacaactctaagggggtgcgtgtgagagggttgtgatcgattgagcaagcagggggtacgtgactaggggcggcatgcaccggtaattagattggaacaaaaaaggatagggattttcacagtgcttttctatacaatgtctgtaatctatagataacataaccgattaagtccgggtcagtctttaactaccaggcccagggtgtggcaccgggctatctgcttgtgggtttcatttctgccttttaatgtttactttttctttctttggaggcagaaattgggcataacacaatgtgaggggtggtctcctcccttaactgcaccactttacattcccaccagcagtgtgtgagagttccagtttctccttattcttaccaattcttgttattatcatcagtcttttttattacagctattctagtaggtgtaaaatatctcattgtggttttgatttgcatttctctgatgactagagctgttgagcctctttgcataagtttattaaccacttttatatctttttggagaaatgtttaagtcttctgcccgtttaaaaaattgggttgtcttttttggttgagttataaaaggctttttaatactgaatattagacccttatcagacatatgatttgcaaacatgctctctcattttgtaggttgtttttttcactttttggatagtgtccttcaaagaacaaatattttttaaatttttatgaagtccaatttaatctgttcttcttgtagtttatgctttttgtgtcatgtccaagaaactattgccaaatcaaaggtcataaagacttactcctatattttcttctaagcattttgcagttttagcttttacatttagatctttgaccccttttgtgttaatttttgcatatagtgtgaggtataggtcccactttattcttctgcctgtggatacccagttgttgctatgccatttgtttaaaagactatattaacttctccattgaatggtcttggcacactcactgaaaattaatagatcataactgaatgagtttatttctggattttcaattattttccattggtctataggtctatcctatgccattactatcttgattactatagtcttgtagtatgttttgaaactgggaagtatgaaacttccaacttcgtctttcttttataaggctataagattgctttggctattttgggtctgttgcagttttagagtcaatttttccatttttacaaaaaaatggactttgtgattttgataggtattacataaaatctggaaattagggtagtattccatcttaataaatcaagtcttctaatccaggaacatgggatgtctgtccatttatttaggtcttctttaatttctttcagtaatattttgtagtttgcagtataccagtcttgttcctccttcaatatatttatttctaagtattttattcattatttttctgagacagaatctcactctgtcacccaggctggggtgcagtggcatgatctcagattactgcaacatctgccgcccgggttcaagtaattctctggcctcagcctcccgaggatctgggattacaggtgcccgccaccatgcctagctaatttttttatttttagtagagactaggattcaccacgttggccagcctggtcccaactcctgacctcactcctgacctcaaatgatcctcccaccttggcctaccaaagttctgggattacaggtgtgcaccatgcttggctgacctcccattttctaccacatcgagtttaaaatcccttgcttggtttttaaagccctgagttccccacgcctccaagaaaacaaagaagattaaaaattcaaaggaaagttgagaatggagctgactgttcctctacttggcaaaggcctcatgtctctgatatgaggccaaaatgtttatcagtgcttcctgtgcaccaagcatgtttctaagtgcttcatgggtaggtcatagagccccacagccttctattattacattttacagatcatgaaacggaggcacaaaaatgttaaataactttccaaggtcacacagcttctgagaggtgaagtcagcattaaacccctcagcccagctctggatccctggatcccataacctctccagaaacatatcctactttaagtatcctttttctgcttctgtgcctaagggcatatcttaactctgagcataaatttcctttagggtctggcaggctatggataacattcctaaattcttttgcagttggaattttgtatcacaatgggtgtttttgtaagtatttcaatgaggattgtgaatccagccccgctagtaactatcatcttaattcagaagtcctcatggaattatgtgaatataaatttggttttaatgaccactgttattttacagacgagaaaaatcaaagtccagaatgactaggcaacctccaagacatagaactagttagcaaacctgggatgggaacttgagctcacccttacttggtttgttccctactatgccttgccagctaaactctctaagaagctgctgaggtgcaattgcatctttccttacctctttccaaagtgcatcctcaaaagccacaggcaaactttgatttgagttttttagcctgcttgatttctacttacataggaaaatggaatgcacacccttacctgagaatttctcaaattaggctggtgacaaataccttttaaagctcctttatttgacatcctattaattttttttaaactcccattcttttgttcctgacagatctgttatgtttcagatgtgacacaaatgtacacttagagggaaacttctttaataagtgatatttgcctcagactactgaggttattttagaaaacaaaagccaaagtacacttaccaggacattcaccttttcataaatttatccggcatatttaattgatcgagatttctgagttagacagttatcaacgcatgtggtaaatcgttaagcgtgtggcattaatgaaaggttttgccgttgtcgtggggaggaagcttcctggcacatggatgacagggcctcagagacaatgctgcttgggttagtagctggggcaggctgcattttattacacgtgtccagaatctcatagtagtcacgtagactttaggagggggaggcaatatttgtatccctactaaaaccaattatggcaaacactaattattcagatttgagccctttactaaaaaatcccctgaactgggttttttaagtcaggctgtcgtagcagagccaagcaagagagaaaataacggaataattggaggctgctgtcttttcactccccacatgaaattatttgaagagacaggccagaactttaaacaggagataccaagaaaagttgtaatttggatgtcggctgtcatgactttagggtgtttgcttaaaggacttttccctcactttctctccttccccagacgtacttcaatgacaatatcctcaccctgatacggaccctggtgaccggaggagccacgccggagctggaggctctgattgctgaggaaaacgcccttagaggtggctacagcaccccgcagacactggccaatagggaccgctgccgcgtggcccagttagctctgctcgatgggccatttgcggacttaggggtgagtccacagcaccgaggtcacctgagcttgctgtttgggaaaagcttgatcctgaagaacgtggtatcagatgtgacaagctaggcatctggcttttctccttcctattgtagataactgtaagaggtgatatttatttatagtttactctggatcagacactttgctctatgcatagtcattcattttaatcttcatagcaaccctttgatataagttctagtatcacaccttctaagtcaactgaggcccagagagaatgagcactagacctattgggaatttgcaccaaggcatcctggcttcagagccagtgggctttctccctccttggtgttctcttcacgtatcctctgcacaaggtgagaagcagcaggtgatgccagcatgcagccaaggttgggaaatatttccacaggctcttagcgtagcttagggatactcaacccaactatacattaatagcacatggaggtggccagcctcagcctgcaggtttcttagtttttatatgtgaataggacccaggcactggtggttttcaaagcaccagggtagtcagtagtcagatgtatccagaaccaccggccaaacaaaccgaatcttatgtggatcctttaatgcctgtaaatcaaaacctagaccttgtaatttctgagagtggacccagtcacgttccctcatgtcctccctgtgacggaagtggccagcgtctcccttctgattccatgtatctgcctagtgtaggcactgtgacagaagtgtgctgtctttgcccttattcccagcccaaccccacagatgcatttaagagatgcagccataagtcacagaaactgataaacctgttacacaaacaatggtgtcgcccagaaagactaaatagtggaaaaggagccaaggaaagggtctgtctctgttttttctgaaacagtgctgcatactttccccatattttagtttgatcatggactgggacctatgttagactaggctttttttgaaagggaattttcatagctagtggctctttatacctatcatttacttattgatgcacttgattaggataaagactttagataatggtaagatttggtcccatcagtgttctttggtatgagaccaatatgagaattccaatgattggaaggacaaagacagtcattttatacccagtgaagccatcccgcagtgcccagtgcccttcatataatacaggtaacatctacctgaagccacctggccgctgaagccagcatttccaagtggatgcatttgctttcactttctgcatcaggccccagaccccgggaaggtggctgtgaactgatcagaactgcgaatcctagttattcagcctgcagacccctggctcctagggaaacacattctcttgcacccttgccatctctgaggtctgtaaattgtgcttttcacagggtccttacctcctgaaagagtctgtcaccataggacctggtggggtcctcctccttgcggtggttttcattatcactcagacagttttgacaacacgagcctatcacagcggttacagctgagctgggactgaacataatcaccattttgcagagaagggttcatctcctcagctgagcatacatctgagaccatcaagctttacactttgacttaaagtgagggagaagcataatctccttagagctttcaaaccccactgcgacaggtggaaaactggagagacaccagaggaaaaccccattgttacctgatccctaaaaatcacacatattgggtgtagtctgttaaacatgttgacttcttccactgccgtcccttggcacatggaccctccaacttgggagacaccaaaacaagctttgatgaaaagacccgtttccctgctgtcccttgattttcaggcaaataaaaaggatgtttctctctgttcttttgctgtctcccaggatggtggttgttatggtgatctgttctgcaaagctctgaaaacatataatatgctttgttttggaatttaccggctgagagatgctcacctcagcacccccagtcagtgcacaaagaggtgagtattggtttcaactctgccctcccacctaatcacagaaatattaatatcctttcctgtcccctactgtaaaggcaaaggtctgtatacatctcctcaacatgcaaattactctgcccatattaaatccaacactgagtttggaggtgatgggaagcatttttctataattactaatagtagatgtaaagacattttggtaagaattcaagttttgtattaatagaataattccatcacctaattacaaaagtctgaatacacaaacatctctcccaaactctagctactaggataacatctgttggtacctaatatagagatattttacattgctagtgtttaagataagtttttttgtttttttgttttttgtttgtttgttttttgagatggagtgttgctctgttgcccaggctggagtgcagtggcacaatcttggctcactgcaacctctgcctcctgggttccagtgattctcttgccttagcctcctgagtagctgggattataggcacacaccaccacacccagccaatttttgtgtttttagtagagagaaggcttgttggccaggctggtctcgaactcctgacctcaagtgatccacccacctcggcctcccaaagtgctgggcttacaggtgtgagccaccacacccggccctaagataagtggttcttctgccatatctcagaatcccatatttttacttcacatattttaaattgactcgctttttaacttttatatatttatttttgagacaattatatattatcaccttaagcagagaaataacagtttagatgtgccaattatatttttctcatatgcattaaaataaattcatagcaggcaaaaattaaaagtacatcctagaattaccaagatcagtgagtttgcataatataccctaggcaacagtgctgcagagacaagcgtttctcatccctgcttgcatagtagaatcacctggggagcttttaaaaaatattctgattactctaacttaactggtctggaaggaagaaaacatcatatatatattttaaattatgtaaacattttatatataataaccagggattatagtgtatagccagaattgagaacaattgctatagaccagtgggttctcaaaatttagccatcatgagactcacctgcagagcttgttcaaccacagattgctggaccccatcctcagcacttccaattcagtaggtctgggtgggattgcttaagaacttgcatttcctagttcctaggtgatgctgacctgtgtggcctaaggaccacacttggtgaccactgctctaagtgaaacagcgtgattttcttagtcacatctgctgttgaccaaagaaagctccaactaattgtgaagaacaacaaagtagtgctgataagtaggcaggtttcttagattcttccatgtggtgaattccaaattccaaattctctcaccaaagtagattttaaaaggtaaagagcgagaatagtctaaggagacactctgtcatggtaaacaaagatcttgtgatgtatatctgggattgtccgaaaattatgaaatgaaagttgcatcacacttcatgaaacctcttgcggttgggctacttgaaagtgactttgaccttgtatagaaaggtacatgtagaccacgagaagcgaagtttggttcttccattactggctctaattccacatctctgcctgggctcctggctggcctcctttattgagttaaacagaggaagtttccatttaacaagaaaaagaatgtttaaggcctcagaccagctaggagtgcatcttccagatcctctgaaagtcctgagtaaccaggccattgcttttggttcagagagagttgaattctttactcagttactctcaggaggtgacatctctgctttccctgtccaggtatgtcatcaccaacccgccctatgagtttgagctcgtgccgacggacctgatcttctgcttaatgcagtttgaccacaatgccggccagtcccgggccagcctgtcccattcctcccactcgtcgcagtcctccagcaagaagagctcctctgttcactccatcccatccacagcaaaccgacagaaccggcccaagtccagggagtcccgggacaaacagaagtacgtgcaggaagagcggctttgatatgtgtatccaccgccactgtgtgaaactgtatctgccactcatttccccagttggtgtttccaacaaagtaactttccctgttttcccctgtagtccccccctttttttttacacatatttgcatatgtatgatagtgtgcatgtggttgtcatttttatttcaccaccataaaacccttgagcacaacagcaaataagcagacggaccaaaagttatttatgattctgggggaaaaataacccaaaggcatgctccagacataaatagctcactgcaggaacgagttcacagattagaagggagcacttgtgatcaacgtcagttaggcagagcaagtttatttaatgtaaaagaaaagttgattctgatttatcaggattatcagggtgctttgggttttgattttgttgttgttgttgttttcctttctttctttttttatacacacaataagttagcacatgtttatttgaaacaagcaaccaaacagcaatgaaaacatattgattgtttccagtctctgggccgaagtattgcgaagcatttgaaaagctttcacgatttgtgtagatgattatgaaggacctgcttgttgcaagagaacatcagtgatttttttagttactcaccaaggccttttgtcccagagccagttccctctgggagttcttatgaacatttctcaccttaatatggaggagagaatagtattccaatcatggatgtatcaaattctagtcatttagtttaagtgaaaagaggtttgattgcatattaaattgttattctgtctccttatgttgccatatgaatagctattttttttctttcacttttgacatttgggatgaaaagccatatgtatcataaatatcagatgtaagtcattaaaaactgccttcctgggacttttacatcttttaaaaggtgaattacttaccttatgtacagaataaataatgctcaggaaagagcaagtatttttccatgcattctcaggggatctttttactcccctttgtttgattagttagggccccaatgccaggtaggaggaagggctggggcaatggtagagtgagaggaagacaaacccagctgcagatcatgcttttctaggagccgacatgctaaataaattagaatgtaggaggatcagccacagttgactcaacaaagacaaaagccagccaccaccttcaactgttggcacagctgtgcggtgctggctgtcccaatgcagaaagctggtgggaaggaattcctcatcatcactttctttaatgtagccaatttaggcagggtaatgacggcaatagagagctgctccttgtcattatgagacgtgggataagaagagtgcaacagtgagccaaacacattttggtatagttatttttttcttcttttgttttctttcttttttaacacttagtaagcatgagaggagaggtagaaaaatacccttttttcaacatatagttgtcagatgctttgtgcatgcaaatcatgctttaggcagtgcggtatttcttaaaaactggccaattcaccataaccaatttctcttatggatggactaggctggtatatacatatttgaaaagttttacttcaaagaattccatcgaatagaataggggtaaaagggaggaggaaaacatgtcacagctgtaccatctctaaaaaggtgtttttatggtgaatgttttggatttagattttggatcccccgtcccctcaagcatgatagttttggatatttgcttgctgtgtgaattgacaagcacttttactgacaaatggtgaggctcagtcagaacctccaccctcccccacaccaaagacaggggcagcgtagtattcaaaccagtattgtggtggggaataattgtatacatgtaaattatcaagccctatgagtggaagaattttttcaaattatttttgtctctctatatattgatttatattatgtataactatctctttatataaactatatataattatatatatataactatataattatatatatataactatatatataactatatatatgtatcccctagtattggatcatgaagagctcttcatgcattctttgcaaaggaggttataaagttacgccctcagaacatttataactataagaatgtgccagttaaagtgctcaacaggaaatatgacagtttaaaagcattgtaaaactcacatagcttacttctctctctaaagtgcaacaaggatgaatagaatgggccaaggtatgacaattaatggttctgcatgacctagccactgctgggggttttcttctataacgttgtccttgtgaaaacttttgtgaaattaaaaaaaaaggagttacaaattttattctgttattggtttgtttatttttatttatattgttctgtttgtggttttatttattttgttttgcttttccccccctcccctttccctctccttttcccttccttcttctcttccttccttcttccactttctaaattgctcagcgcaatgaggctgtgctgctgctatcgctagattccttagagtttgttttggtgttcttgggtgtggggttgggtaatttggggggaacttctctccatctggcttgccttttaatctgcacgtggcctccctgcccaccctggtaccttgctccaagtccgaaagcattttcctatcaagaaacccagcttccttcacttcccccattgccaccccccaatcccagtccccccatcggtctgttcacatctctgtgttcatcttggcaagacctactcaatcaagtgatgatgccagttgataaacttccctggaaaacatttacagctattccatttggcaaacttgcttctctgtcaatatttcatcctcctttaaaccaggagggttattaatggcaaaagcattggtcttctttatgcttgatcagtatgactcaaattaaaagtgttctgctgtgtatatcaactcagtagcccacacccagttatctgggagctgatggttcagtcactgtattacccaaatctttcctgccagctgcctttcagacatttgttaaatcccaaccagagaccgggcagatagagagaagtaaatctgaagtgcgttttatatacagtctgttagcaactccaatgagatgatattgtgatgggaatggaatgggaacagactatgataagagatggaattttgaggttttcctggactttgggcacacagtcatgccccagtggtagataattgagaattcaccatatttgactaatgataaatttgatgatggagaaggatcattactacttcaattttatttgccaaaattactatattatactttccttaatagagtgaagagtcccctccattgttttctatttgactccaaacttccccttcctctttcagtagaacatctgcttacttaggaagtaggcatacaagtttcttattattatatctcttcctgttcactgcctcccgcaaaaaaaaaaaaaaaaaaacaaggaagtaagggtagaaagtgagagttctttgaaaataaagtatatacatttaaaaagttaggaactctgttatctgcaccattctagaagagaagaaatttgtaagccatttagtccaacttgctttgggctttgaaaggggtgaacaataagtaggctggtaaaccagaaggcacggtgaagccttctcagtctcaacacttgggtgatcgtggcatcatcagtgtccctaaagtctgctacccaggttcttcccaaagccagttcaaatggatggagaaagctggactcttatacacacagttaaacttctgccacaattgggagaggtttcaaattctgttctgaatattaaagattatgacccagaaccttaccatcggtgctcaataaatatttgatataaattgactttacacatttttatacctttaaccattttctatattacccttgtcctcttggtttgatttttttaaaaaaatatgagtgcctctacatgccttatgatgctgctgtgttggtggcactttctcaagctggtcacatggcttctgagaaaggggaatagccctgtaagctcaatgagtagagacactgagtatgcctcttggcagcatcatcaagatcccagatgaccagaaaaagcttttgtctggctcttctgcagcatgggaaaagcctaaaggtgtctgcatcccaatagagacaattaaatcaacctgccaggttcctatagcaacaggctccttgaaggagaaagaggagagtacagaaactccagggcctgtggaagtcaagacagggtaaaaatcaatttctcaatcagcttctttcagcccatccctgctttgtcacaatatgataaagaagtagctgtgggcacctgtcactacactggctgactgtctcccatgcaagattgcatgcccattgcaaccattggaggtgagagggattatccgaaagggattagtgaagaatctgtcctcagggtgttggctggaccaagggccacagaggagggctgggagagcagtttgctcaaagaatggcagcatcagactttcagttaaaagagacagagtcatggtagccaattgcaaagaagtgagaaggtttttcataaacggtaattgcttttgttctggtacaaataatttgtatctctatgaaataagcatactttgctcacagagaggagaggaggtagtatgtgtgggtggggacggaggaggcatcagggtttgctgggcagaggaagtgtgccaggctgcctatcacaagcgcgggacaggaaaccacacagcattacccttgaaggtcgaagctccttgttagcccttactgttctccacggttgtctctctccaaacagcatcttttctttttgagccttttctctctcaacctcagcttgtggtgtagtgagaagagggccaattattccaaatgcttttgctgtatcattgtctccccttttctgcgatcttctcaagggagtactgtgaaaaggctaaatcccatggcactgacaacccacagagccaacagagaagctcaattatcacagtgcagcctgtttcttcctctgctggtggcagctcagtcagcccagctctggggcccttccctgcaagagcccattcctccagggtgacctgcagccctgtggctggaggaggttttgacccttattttaaaccctgtgatctcagtgatgaaactagaaatgcaagaaacagatggctctcagatgggataggatgcctggtgagtcaaagccagtatttcagaggcacagagtcaccctgggaggggaaaaaccctaagctccccagaaataacaccaggttacctcttcctctcctttaccttccaaatgaagatgaccaaccaaatccccctctgtcacctctgctgccacaatccatgttcttcaggatacaccccgatatacacacccctgttctctacccccagaatctctgctgaagggcatcatttgtcatcacattcaagaggtacgacccatgcttacatcatcctttagtactgatagtactcaggctagtactaaacttactctaaaagctaacgcttcagcaattgccttgggccaggcattctcatgagcactctttagttacctatacaaactcaatcctcacaacagcttcagatggagatgctgtgtctccatttgaaagacacagaatctgagagacactagagtctgtgaagttagccactgtgatataatgcccgctgatattattccaaatactcataaccttaacaactcacatttacttaccatgtatctggacctgtgtaagtgcttcaagggtactggcttcatttatctaaacaacactattaggaagtttgtatcatcagccctattttacagaaaaggaatgaagctaagataaatttgctaataacttgttcagagccatgcaactagtacgtgagctagatctgcttaactttcacctcctgccctgcgctgtctccttagcccgcatctccttgcttcttcatggtggacagctcatagcatagctggtcttgataggtgacatctgccaatggcagtggcaattgctctaccagcatctctctgcagttgttttccagagtttatcttgtcccactagccccctcccagccacagactgaaatgactcttctttcctaactccacgaactcctgacatgtcacacattgtactcagagcactgacaacaggcatctcatccttaagaagcttattaagaaataaggctatttttctctggcagcgaggaagccctcccaccccgatcaattgcccttctcatcttagagatgaaaataaagcccctggaaatctttctggtatgtgagatgaaacagggagtggagataaagtcagggatttggatttatccttgtcatggcagcattcattagagctgcttccctgagtcctcttcctcgtggtcaattttgtagccacccattggcattgtttcttcttcagaaggcaagattcaatacatcaaattatcattgtcctacttgcagcactctccatggatgctgaatggctggcgatcattgaaatgtgtgttccttggaagcatgttgggagaatctgttcgtaaaatacctttgcaccagacattttagtaaaacgcccagagcattcatacagttccgtttcctgaacatcctacataaccaagtctccaaaaacacacacatttatatcttaggaggcacccaaattaaacagctgtttctcaggcataaggaagacctcaactcctcaccacaatgtgtgttaacacaactcactccttgtgttgaggcagcatggccaaaacatgggctactctgcttagatttttttttttaatggcaagaaatgtaaaaggaaagagagaagtttaaatgaggaaataatgctctctttcttacagacagcagaaggaaattgatattctctctgccgcgaaaggtcaaaatgccaactttgaattgaactgtaaagactaaattccgaacaattattctcttcagcagttgtaaaaatttcagcaaattgcagctgtcttaggtctttcacccaaaagacctactcatttccatcagctgagttcactcttccaacctggcatgtccaacctagcactaaatccctttgcaaagtcagtctgcataacagcatggccaaaaccgagggcagctcaggcaacctgagcacaaacaccaggctcaacctctctgaaaatcatctttacacataaacccctggaaaaagtcgtagtgtgaaattgtttcagcggcctggcaaagcttttaaaacatgataaccatcacactttactcctctctgaaaggttagtttaatcgtagatcacaaaaaattggtttccacaaatgcataatggttcatctatgtcacacttgaactaaatggttttttaaatggagctgaaattattttgatgtgtacacagtcccggatttctatacaaccttttttaaccagcccatcaggaaccttgcctctaaagcctcattaataattcagatgtgctgatgactttaaaagatctatggaattgaagcttagggaaaaaaaaaaaactctgcttgacaaaaagataaatgaatgtagaaagaagctgtaggagtctggcaagctgtagatcatctcagaacagattgtaactttatcattctgtcagggggaataatttaaagcacttaatcagttagcttcactgtgaggatgtagcattatgaattcctatcgtccaatctgttcaaatcaaagtgaacttaattataataggtgagtgagccagagcaggagagggggtggggagaacgaggcaagaggcagcaagtttcctgtggggtaaactgagctgccgcattaaactggggcgaggctttgactcaggcatatcccagctccagtgacagccctcctcgacattgacagctcagggcacttgaaatagcagaagtaggaactgaggagaaacaagcagagtggtcatgaactgatcatagataatttataaatcattagccaaacatgcacataccccacccccaacgccccctatcaaaccaggtgagcagttttcactaatgtgtccattcaggaccactgacaaggcagttacaaattgttctggtaagcagaaaaagcagctacagaggccattgtctctatagcagtggacgtgcttgatagcttttaccctttttctttttcttttctttccctaagccactaaagtgaggcatatgattcccaagttagaatgtcctatttgcccagtcctttcctatctatacacatggccaatttcccagaaaatttcaatcctagaaagaggtggggatgagggttgagtcttgtaaaatagctttgcactgctaagaggatgctagaccattttcattctcaccccagcccccaaacgccctgactcagcattctctctcagccatttctgtatttagggtggaaatgaaatgccaagacttcattgagctcccttgtcgacagcttgggttattatagtcagttaagatattgccacttggaactctattcataactttataccaacacagagttttctttcttgaaataaaagccacctcaaaatcctctttaaaacattggtcgctattctgattttcatagatttttggccagcaaaatctatgggtttagtttagaccccccaaagtggctacaaatgaaacaggagagtggtatagttgagacatggctttaagtgtgtgtattataagcaaagccaagaaaaggctgggaggtggtgattctgtgtaagattctggatcactcgctctgcagcaagggtgatggtgcccttccgttccactcaaatcaatggatgcacacatctctcctcaggcacaatgtctgtacccaatggctgatatatgcaacatcccctccccaccaaaccttttctggccatgaaattaactccaagggacattgccagagtccattctccaatccctccttagcctctgaggtccgcccatggtgcctatgagtcccagtggcacattttgttcatcacttgctacaggaagcagaggtatatttcaggttctggggtcctccctacactgcactgtctctcttagcaattactcactgtcggcttctatcgattacctttttgcgtttttcaatgaactttccaaaggctttaccctaggactaattaaacttctcatttctccttcttgttctctatccattttgccctttagcagaaaagaaatggtttacagatgaaccggataatgcctatcccagaaacattcaaatcaagcccatgagtacccacatggctaaccagatcaaccaatataaatccacaagcagcttgattccaccaatcagagaagttgaagatgaatgttgactcccaggagaccagaactatttttttaaagcctgacaaacttcataaatggtgatgtgacttttcttcttacatgctgaatcactggtggaaacgttaggataagcaagaattgccagaaaataaagtagacagatctttctctttgtctgccttgaatattgcttccatgtattttggaaaagaaaatgatttcatttataaatgaacatactaaaatagtcatgtatagcctctagcattttaaattatttttatttattagaaagaaaatatattttttcttttcattgtcaaatatcttccctatatctaaacaatgcaaaatctaaatgaataagtggtcagactccttaatgtgtttttctcttctttctctctttttctttgaggagaatgatggtcaccaccacaattaattgtaattaagggaaatgaattattaaaacaattttaaaatggccaatgatgtatacatgtattttagtaaatccagaaaagaagactaaggggacaggtgaatacctgctcctcgcctggatgggtgtgtattttgatctgcattgacaccagctcttaataaatggaaacttatttattttcacagttgaaagtcatatttttgtagttctagttttcattctgtagttctcacccctttgttcatatttttaaagggaagaccttctgctgcttttctacaattggcagatcaggtttgtctggccaactaaggacaccaggagggttgtgggcacacctgggatgtggaagctgaggaccagatgcacacaaggcattgctctgtttgctgttctagtggtggagactcctacgtgctgttatgcttctcattttatatttccaaaccacctgagcgagtaatgtcaacttcgggagggtctggtggactttctccccactccccaagtctcagagcttttagcctggaagtttgtaaaactgattagtagttttactttaccataggatgtgagagggcagtcattcttctcactgagtttttgtttaaaaaccaggaaatttctacaatcatggagacagattttaatttgcatgctctcctttatttagttgctggggccaaacacatgaacttgttacaacaatttaaaaataataataacaaaaggaaagcaacgaatgcacttcatatagactgttagaaaaggcctttgaaaattaccagcagtgaaatcaaataaattagccactttaaactgcggtcaaaagatttttctagccatcagatgcaattacgatgtctcagagctctgctatcgcttgcatgctcggtgtacagtctcccggcaactgttttgttccaatcaacttagcaagtctttcaactttaaaattatcaatctttgatatgatcatcaaggtctctggagaagcatggatgtaatagtgatttctattttcttaaaaaatgtaaactgtggacacttaatggaaccaagctaaccaaagtatctccccgaagtttcatgatatctagtccattaactctttgggccatgacctgtggtacctagttatggtagtgcaaatcagatcagagcaaagcaatgagatcatcatgaagacatatgtccactaagtactccaattaccagcgtaggcaaaatgagcttccacctctgtccactccctgcagagccaatatagtcgtgcttccacctcgtaggcattgtcctgcagtgatttgtcggactgtggttactctgtcgtcacattttgtagaattagttctataaaagtattgtgaatacaatgtatgtccaattggattgtttaaaaactacttataattaatcactagcctactcagcagactaaaatgatgtcaacagtctatattcaggcttataaacatttcttggtttccaacagaagtcaaatgtgtttgtggggagaacgttttgctaggattttgacaactttcctgaaagctaggccttttttacataatgattttgcattggggtcaccttagtatattcacgtcaatccacgctcttctttccttcgtgaaccatagtgggctcttcactcctgctcgtaataaccacctccaaatttgttagagtgatttggtctcctctggcaggctgtggtggccacataaaggatcttccattagagggacacaggacacaaagctccattcccatgaccctctcttccctgtgtcacccctaacaaggcaatctggaagcagaaatgcaaactccagccccaccacacatccaccgatgcatttgtggctagaaattttaatctaaactttttttaaaaaaaatcataatagttaggatagtttcctatagcaaagggctccttgattcataagcacctcccccccaaaaaaaccaaattggtaaaaattcattttcttttaaatagagcaataagttcatactgtgttgccgttgtaataatgaattgttctggactagaaaacaaaatgaggcattttgttaagggggtaggaaaatgactgattgttgggccctttggcaaaagctggtgcctggtaagtagaaacgaaatggaaacagaaataacatttgtgaaatcactggagggctcaagcaaatgccagagcttctccctggcttgttcctacttgttgagctctttggccctgagtcccatccatctccactgcaacagtctgtctttctgcctacatccgcctgagaccaaggagggtctttggtacagtccacattatgaggctctgatttcctatcccagtttagggctccagaaaagccattctcccaaactaatgattcttgggtgctgtgggtcaccaacaggctgtttacaaagcagaaaatatcatcaccatcataacctttctccttgagaaaacttttatttttgtctaagcaattttatattttagaatatcatcttgaaccattataaaacaccttaaataaaagtgattgtgactaaggcacgttggagaacattccaatctttcctcccaagggttctggcaccttatgatgtactttgtaaaaaaattgattgaagattttaaataaacaggaaattagaagtgttagggttagataaaggaaaagtgaaaaagcataagaaatttgggactttttcatgttgaaaggagaaaaagcacaagttccctagttaccatttaatatgagggtgcaagagccacatttacaaacaacaaacttgatctttaaaaatgtttttaaaactctctgagtctcagtgacttcatttgtaaatgagagtgattcatctagatgactctaaggtctctttcaggtcccaggggacgtgatctaagttaggagtgggaacatgggagtggctgcttctccttggctaagcccatgcagactattgtgtccaggactggaataaaggtcctttttgctgcatcacccaggcaacactcccagccttactcaggagtggtgaacattttctgctctggacatagaataggtaggttcattcctggtcttttcactttagattctctttaggttcaagatgcagatttctcaatttggacacacctgcatcacgttggtcaaattttgctgcctgtttctagggttttcttctcagtttcatccctgccttcccttttttgttgtttttttttggttcaaggcccagcttcagttaatcccttcatctctatgccatgtctccaattcctagtatgtaactagaggttcaagagaccccaaattcctgccattttccccatttatgtttccccatgtgaatcttcaggaagtaaccagtcttccttctcacttcatttcctgtcctctgtttatttggttattttctttcattaataaactaaccatctcttagctacttacattcacaaatgtaattttaatctattgtgtttcattgtgaaagagaatctcattgaaggaaggaaggaagaaattgaggaataaaggtaggaagggagagaaacaaagactatccaaccaattgactgagatgtgagccggcttgactcctaggagactaagtagatccattcagcttgaacactgagttccagggcagaatctgtccattttctgttttgttcttacttgctgcttttggaatggtggtaaagccaccagtcaccatgagccttgaaaggaccttcactaatgaggacttgactcaccctctttaaaaagcaaaagaaacagaatttacttacaatcttctggtaaattacctttctgatcctctccttattcccaaaaggcaatttttttaatccagcagagatgatttagcatataaatcccaggtcatttgaggaggtgatgacgctatttggatttatttatgagacagtagtaattataaatgattcctaggcagtttgtactagtttggtcatattggttgtttaagtggagtctcttctgattgtttgtttccaataaagtatcagttgttaataatttcaagatttccataaaaataagaaaacttggaaaacatttttaattttatttcttaagagaccacagagcctaattttcaatttttatggtaagcttgcttaaaacatgtataaaaagaagcctacatgctcaaaggcagaggcacctttagccctacaacagttggaagctccatgatatcacagccccacatggatagattggagaaagaattctgacttagaccacctgtagcagaccttcctcttttggcatatttttttaatcacaaaaaggacctgagactccctatctaaagataagccaaacttggggtatacattaagaatctgggaagaaagaaaaaaaagaaaaagatataataagcagtattttaaaataccatgagttatgggcatgcatatggtacaaagagtagttctttgggttgaaagaaagaagagtttgcattgaactgcgtaggctggcaagaatgcagaggtatacaatgtttgatgggctttggaggcatttcaatagtaaatgggtgacaggactggaaagatgtggaatatgagggttttccagggagatgggacttaatgggccatgatgtatttgtaggaatgtgatttcaatagattgactattttgtctactgtgataagtttgtgtaggggaactgaggaaaactgagatgagacttcatggaaggggctacaaagtacagtctaaaggcctagataaagtttgaaacttgatttagaaagtcatgaaaagccactcagagttttaagcaaagagtgatggggcagcaatggctgtgcatttttcaggttgaaagtagtgagatgtcagttcttcctggaagatatcatgagaatgcacacaaaactgaacattttctcagcagcaaggagtgctaaagggtgcacactccaagtcaacaactcaccgtgtgcagcaccttcctcacacattttgctttgctttctgtcacaggaccatcagacgtagaacgtcctgactctcctgaattactagaatgtcagcaacaaactcacaaagtannnnnnnnnnnnnnnnnnnncagcgggtccttcagcccgtggtgaagacagcaacaaactcacaaagtagattagagggtaggaatagatacataaatttttaaaaacctgccaatcatactgttttctagacagtaatataataagaacatgaggcaggacatccacaaatagtagagaataattaatagtccagaactgccaaataggaattccccttatgaaaacacccttgcagctaatcaggtagcccttgtttagaaaccaattagcactcataaaatatttgtacaaggagtgagtgggggagaaatgagcacaatatgggttctgccatcaatcagcttataatacaactaaagaaagaaaacatgctcaaagcaccattagagaaagggtgagccctaatgacatagtttcacattcaatatggtaggagttgaaacaagggagaaatgctgtggtttgaagtggttcaacaaggtaggatttctagagaaaggggggtttaggagttagataagtagaggatcagcattctaggtatgaaggcaggattatctggcatgtggcagggtgaatgatgttaatcagtaactgctaattgatatttactgagcagctgctgtgtcctcacgatggtaagactattagaggaagacagcccacctgcctaactgggaacacaaggcacacatatattggaaagatcatgttgcacaaaacaggtgttcaataaataatttttgaataaatgtgaacactgaatagcaaataaatgttatagatcgtaatagttgtagaagattggttgggattgtagggactggatgtggggcaatggctgtgggtctagagtatattcattgtgcagtggacacacacctaatctgtcctcaaggacagaaccatgtggaggaataggaaaacaagagaagcaggcaagaagcggaggcagtgagtacagcagctaagaaatgttacattgggttcatccagagcaagaaaagctgagagctgtccgtgagggaaggccacacaggcaagaggagtgggacaggggagtaaaggagtgggctacaacaggccctgcagatgtggaagccagacccacagaggcacttagaaagtgaggatcctggatgaattattttagggagaaagtgtaggtttagatcagctggcagatgtgtttgtgggctacagccaagtttttcaggactaagaaggagcaaaataagtagaacttcttgggacaggagatctagggtactccagaaccagggaaatgagaaacaagaggggaattttaagaaagagagggaagatcatctatgaggttggagatgaaaggtgttggagatggtgaggcacaagtcaaaagactcactcgaagggcaggaactctgcttatttgtccatattcccagagtttgtcatgaggtctggcccacgtgggcagtcactcggccactatgtatcactgtggctgccatggtggatggaggctggacagaacctgtggtgatcggcagtctttctggaggactcaccagggaggggtctcagggtgggcatctcctttcaccttcctgtgcatgtcactgcactgttcttcttccctccctgaacagcacacacactgcatccttagtttcaggggtctgaaaacaaatgctacgaccaccttgctttggtggcttttctgaacaggcattgtgagaagagatgttctggccaggtgaaagtggactttatttttaggtaggtttttcagtttagaaaggtttcctttgcttatcccttgaggacttctgtgctgctgcttctcctccatcttgctagttaacagaacaggggcagaagtgacaccaatgctctcggccatgcctgccttgggaagcactaccgggccccactgtttagaatcttagatggaaatgtacacaaggcattgacacacgcctgcgggagtgacccagtgcttccctcccatgggactcagggtcagcgtgggaaggcagctggcagggacaggagccccgcccgcaaggtggactgagcctcacttccacacaaaaccagagtcccatctgccccagagcgctcgctctcctccccttccttccgctcaatgcagcctgacacgcctttgaccagaactgcaacatttcaaacacaaacccagatctgttgggaaatcctaattaaaaacgttccattcccaggtggcacaatcacatcctgcctaaaacttctggcccacatcccaccacccagatgttgaaaagaaacctttctctgcttaacaccaaaacctgcacttcaaggtttctttaggggacaaagaaaaaaaaagtacacacatgcagagttcagcctacatgttcattgaggaaaaagagcgtggcttattcatctttcaatcttttgattgttggcattatgattatgattatgattaattactctgacctgacaggaattgaagaagagactatatgctggtgctctgaaatgatctacccaactctgtcatctgtaacaaccagtgataactctcttgtcttgtaaaaagggtttgtacataacttgtacatggtttcattttgtatttttcgcagattaaaaatttatgtatttgtgttctaaaacaaggagtgtttcttgtgtctttgtagcagttacatgccatgggggtgagaggtgagctggggatggtgaggtccctgagttctaatcaggcagcttttgtctcctcccttcatgctcctccatgaaggcaaagttgtggattgattgaaaccatgagcttccctttgcagcttcgagtgcaaatagacctccccacctccatggtcttcaaggagccagtcagtgggtgctgcccaagactgcaataggcatggcagagaggaagagctgctgtcattcaacgtggtgcctgagagccctacgcagccacactggggccaatgggacaggtgctcctgcagaaggctccagcaagccggccactaaagaaatgcacagcattcagtaggtccttgaaaagctaaagcatttctcccctcagccacccactctcaagctagttaccatttcctgccatttgcacagacaaatggtgttctttcccctgcatttagcttatcaaaacccaggacaatgtgttaaaggtttaactcatcctgctccacgctcatccccaacagggcaacagatggaacttttaaaagccaaaaaaaaaaaaaaaaaagcccttaaaaatgaatgttgccatgttgggccatgctctaaaccttcttcagaaccttcagagtttgcactcttttcaggggcctggactcccaagagtaaagctggtccagcctagagaaagggaaggatctggagaatgggaaaaagccatccaaggcatacagatgtaatgtgcagaatgtattgagatttaatgtattctagagattgtctcatttgctcattagccaaatatttactgaatagctattatgttaacagtcctctgctgggagctgggaaaacaacagtgaggaattctatgattccagttctccagtctgggggagggttgggatcaacaaataaacaggtgatagtcatgtattaaaaattgatctgcaggggaaagcacagtttgccattgggaacacatcagaggtgcacttagctatttgaagagaagtataccaactgatagatattttaaaaaaacaaatcccccttctacctaagtcagtataagccctaactggaacttatttccagtggtcagcaaatgcaggtttacctgtcagaatgtgccagttcctgactgtcctttgcactccagtttctcaacttgccttctccaatatttgctaacaaatctgaatgttgttggggaatgtaattgcagagcatatggtccccattagttaggcaaactccactgccaaattcagctccaaggaaggagtctgcgtaaaggatgaagtattaggaaaacatcgacagtgacagagaaggcaaatataagagatgagacagtgagtttcaaaagagcaggctcggcaaacccagcacaatgaatgtggaacataattttccatttgttgagaaaacaatatatgtgaatttgtactaaaatctccctgtagcaaaaatcaaagtagaccattcaccagaatcaatgttaactgctttgcaatgtcagataagatagattctgcttgggagaaaaacatgggtggaacagaatagagagtctgctaaggaaataaagcaagagtgacatcaaaatgtaaatacagacttaacgctattttaaatgttactggaccagcctttgagaggagaaacagaatctcatgcttaataacctctcacattcagagagtataaaaacgtaggctaaatgtagtcagagacatgaggtcccccaagacccaggaaagatgatcagacaaggtgagagcctgggcttcatcgggcagaaggcagattccccagaccagtcaaccttctgaaaatcaaagagggacctgggctgaacctgaacccatactcagcctggctgcttggcctcctctcccaaggagctgatgctatgggtccttcaccccaaagtctaccacatgctcgctggtttttagtctattgtaattaactcaacctatacctaattcaacagttttttttttgaaaaagcatttaaattaggtgtttccaaaaataatcaacttcatttttctggagtcaacaatctctttccttcacttctatttctctggttaacatactgtttaattcaattgcatactacgataacaagtacaggtgtttaaacaagctcagactgctggtcagct

SEQ ID NO: 167 - DNA, 3507 bp, Homo sapiens
tttttcttcttcctgtctaatagcccaatagaatcctgccagaatttctacaaagatttcacattacagatcgacatggctttcaacgtgttcttccttctctacttcggcttgcggtttattgcagccaacgataaattgtggttctggctggaagtgaactctgtagtggatttcttcacggtgccccccgtgtttgtgtctgtgtacttaaacagaagttggcttggtttgagatttttaagagctctgagactgatacagttttcagaaattttgcagtttctgaatattcttaaaacaagtaattccatcaagctggtgaatctgctctccatatttatcagcacgtggctgactgcagccgggttcatccatttggtggagaattcaggggacccatgggaaaatttccaaaacaaccaggctctcacctactgggaatgtgtctatttactcatggtcacaatgtccaccgttggttatggggatgtttatgcaaaaaccacacttgggcgcctcttcatggtcttcttcatcctcgggggactggccatgtttgccagctacgtccctgaaatcatagagttaataggaaaccgcaagaaatacgggggctcctatagtgcggttagtggaagaaagcacattgtggtctgcggacacatcactctggagagtgtttccaacttcctgaaggactttctgcacaaggaccgggatgacgtcaatgtggagatcgtttttcttcacaacatctcccccaacctggagcttgaagctctgttcaaacgacattttactcaggtggaattttatcagggttccgtcctcaatccacatgatcttgcaagagtcaagatagagtcagcagatgcatgcctgatccttgccaacaagtactgcgctgacccggatgcggaggatgcctcgaatatcatgagagtaatctccataaagaactaccatccgaagataagaatcatcactcaaatgctgcagtatcacaacaaggcccatctgctaaacatcccgagctggaattggaaagaaggtgatgacgcaatctgcctcgcagagttgaagttgggcttcatagcccagagctgcctggctcaaggcctctccaccatgcttgccaacctcttctccatgaggtcattcataaagattgaggaagacacatggcagaaatactacttggaaggagtctcaaatgaaatgtacacagaatatctctccagtgccttcgtgggtctgtccttccctactgtttgtgagctgtgttttgtgaagctcaagctcctaatgatagccattgagtacaagtctgccaaccgagagagccgtatattaattaatcctggaaaccatcttaagatccaagaaggtactttaggatttttcatcgcaagtgatgccaaagaagttaaaagggcatttttttactgcaaggcctgtcatgatgacatcacagatcccaaaagaataaaaaaatgtggctgcaaacggcttgaagatgagcagccgtcaacactatcaccaaaaaaaaagcaacggaatggaggcatgcggaactcacccaacacctcgcctaagctgatgaggcatgaccccttgttaattcctggcaatgatcagattgacaacatggactccaatgtgaagaagtacgactctactgggatgtttcactggtgtgcacccaaggagatagagaaagtcatcctgactcgaagtgaagctgccatgaccgtcctgagtggccatgtcgtggtctgcatctttggcgacgtcagctcagccctgatcggcctccggaacctggtgatgccgctccgtgccagcaactttcattaccatgagctcaagcacattgtgtttgtgggctctattgagtacctcaagcgggaatgggagacgcttcataacttccccaaagtgtccatattgcctggtacgccattaagtcgggctgatttaagggctgtcaacatcaacctctgtgacatgtgcgttatcctgtcagccaatcagaataatattgatgatacttcgctgcaggacaaggaatgcatcttggcgtcactcaacatcaaatctatgcagtttgatgacagcatcggagtcttgcaggctaattcccaagggttcacacctccaggaatggatagatcctctccagataacagcccagtgcacgggatgttacgtcaaccatccatcacaactggggtcaacatccccatcatcactgaactagtgaacgatactaatgttcagtttttggaccaagacgatgatgatgaccctgatacagaactgtacctcacgcagccctttgcctgtgggacagcatttgccgtcagtgtcctggactcactcatgagcgcgacgtacttcaatgacaatatcctcaccctgatacggaccctggtgaccggaggagccacgccggagctggaggctctgattgctgaggaaaacgcccttagaggtggctacagcaccccgcagacactggccaatagggaccgctgccgcgtggcccagttagctctgctcgatgggccatttgcggacttaggggatggtggttgttatggtgatctgttctgcaaagctctgaaaacatataatatgctttgttttggaatttaccggctgagagatgctcacctcagcacccccagtcagtgcacaaagaggtatgtcatcaccaacccgccctatgagtttgagctcgtgccgacggacctgatcttctgcttaatgcagtttgaccacaatgccggccagtcccgggccagcctgtcccattcctcccactcgtcgcagtcctccagcaagaagagctcctctgttcactccatcccatccacagcaaaccgacagaaccggcccaagtccagggagtcccgggacaaacagaaaaaagaaatggtttacagatgaaccggataatgcctatcccagaaacattcaaatcaagcccatgagtacccacatggctaaccagatcaaccaatataaatccacaagcagcttgattccaccaatcagagaagttgaagatgaatgttgactcccaggagaccagaactatttttttaaagcctgacaaacttcataaatggtgatgtgacttttcttcttacatgctgaatcactggtggaaacgttaggataagcaagaattgccagaaaataaagtagacagatctttctctttgtctgccttgaatattgcttccatgtattttggaaaagaaaatgatttcatttataaatgaacatactaaaatagtcatgtatagcctctagcattttaaattatttttatttattagaaagaaaatatattttttcttttcattgtcaaatatcttccctatatctaaacaatgcaaaatctaaatgaataagtggtcagactccttaatgtgtttttctcttctttctctctttttctttgaggagaatgatggtcaccaccacaattaattg

SEQ ID NO: 168 - protein, 955 aa, Homo sapiens
MAFNVFFLLYFGLRFIAANDKLWFWLEVNSVVDFFTVPPVFVSVYLNRSWLGLRFLRALRLIQFSEILQFLNILKTSNSIKLVNLLSIFISTWLTAAGFIHLVENSGDPWENFQNNQALTYWECVYLLMVTMSTVGYGDVYAKTTLGRLFMVFFILGGLAMFASYVPEIIELIGNRKKYGGSYSAVSGRKHIVVCGHITLESVSNFLKDFLHKDRDDVNVEIVFLHNISPNLELEALFKRHFTQVEFYQGSVLNPHDLARVKIESADACLILANKYCADPDAEDNIMRVISIKNYHPKIRIITQMLQYHNKAHLLNIPSWNWKEGDDAICLAELKLGFIAQSCLAQGLSTMLANLFSMRSFIKIEEDTWQKYYLEGVSNEMYTEYLSSAFVGLSFPTVCELCFVKLKLLMIAIEYKSANRESRILINPGNHLKIQEGTLGFFIASDAKEVKRAFFYCKACHDDITDPKRIKKCGCKRLEDEQPSTLSPKKKQRNGGMRNSPNTSPKLMRHDPLLIPGNDQIDNMDSNVKKYDSTGMFHWCAPKEIEKVILTRSEAAMTVLSGHVVVCIFGDVSSALIGLRNLVMPLRNFHYHELKHIVFVGSIEYLKREWETLHNFPKVSILPGTPLSRADLRAVNINLCDMCVILSANQNNIDDTSLQDKECILASLNIKSMQFDDSIGVLQANSQGFTPPGMDRSSPDNSPVHGMLRQPSITTGVNIPIITELVNDTNVQFLDQDDDDDPDTELYLTQPFACGTAFAVSVLDSLMSATYFNDNILTLIRTLVTGGATPELEALIAEENALRGGYSTPQTLANRDRCRVAQLALLDGPFADLGDGGCYGDLFCKALKTYNMLCFGIYRLRDAHLSTPSQCTKRYVITNPPYEFELVPTDLIFCLMQFDHNAGQSRASLSHSSHSSQSSSKKSSSVHSIPSTANRQNRPKSRESRDKQKKEMVYR

SEQ ID NO: 169 - DNA, 3654 bp, Homo sapiens
tttttcttcttcctgtctaatagcccaatagaatcctgccagaatttctacaaagatttcacattacagatcgacatggctttcaacgtgttcttccttctctacttcggcttgcggtttattgcagccaacgataaattgtggttctggctggaagtgaactctgtagtggatttcttcacggtgccccccgtgtttgtgtctgtgtacttaaacagaagttggcttggtttgagatttttaagagctctgagactgatacagttttcagaaattttgcagtttctgaatattcttaaaacaagtaattccatcaagctggtgaatctgctctccatatttatcagcacgtggctgactgcagccgggttcatccatttggtggagaattcaggggacccatgggaaaatttccaaaacaaccaggctctcacctactgggaatgtgtctatttactcatggtcacaatgtccaccgttggttatggggatgtttatgcaaaaaccacacttgggcgcctcttcatggtcttcttcatcctcgggggactggccatgtttgccagctacgtccctgaaatcatagagttaataggaaaccgcaagaaatacgggggctcctatagtgcggttagtggaagaaagcacattgtggtctgcggacacatcactctggagagtgtttccaacttcctgaaggactttctgcacaaggaccgggatgacgtcaatgtggagatcgtttttcttcacaacatctcccccaacctggagcttgaagctctgttcaaacgacattttactcaggtggaattttatcagggttccgtcctcaatccacatgatcttgcaagagtcaagatagagtcagcagatgcatgcctgatccttgccaacaagtactgcgctgacccggatgcggaggatgcctcgaatatcatgagagtaatctccataaagaactaccatccgaagataagaatcatcactcaaatgctgcagtatcacaacaaggcccatctgctaaacatcccgagctggaattggaaagaaggtgatgacgcaatctgcctcgcagagttgaagttgggcttcatagcccagagctgcctggctcaaggcctctccaccatgcttgccaacctcttctccatgaggtcattcataaagattgaggaagacacatggcagaaatactacttggaaggagtctcaaatgaaatgtacacagaatatctctccagtgccttcgtgggtctgtccttccctactgtttgtgagctgtgttttgtgaagctcaagctcctaatgatagccattgagtacaagtctgccaaccgagagagccgtatattaattaatcctggaaaccatcttaagatccaagaaggtactttaggatttttcatcgcaagtgatgccaaagaagttaaaagggcatttttttactgcaaggcctgtcatgatgacatcacagatcccaaaagaataaaaaaatgtggctgcaaacggcccaagatgtccatctacaagagaatgagacgggcatgttgttttgattgcggacgttctgagcgtgactgctcatgcatgtcaggccgtgtgcgtggtaacgtggacacccttgagagagccttcccactttcttctgtctctgttaatgattgctccaccagtttccgtgcctttgaagatgagcagccgtcaacactatcaccaaaaaaaaagcaacggaatggaggcatgcggaactcacccaacacctcgcctaagctgatgaggcatgaccccttgttaattcctggcaatgatcagattgacaacatggactccaatgtgaagaagtacgactctactgggatgtttcactggtgtgcacccaaggagatagagaaagtcatcctgactcgaagtgaagctgccatgaccgtcctgagtggccatgtcgtggtctgcatctttggcgacgtcagctcagccctgatcggcctccggaacctggtgatgccgctccgtgccagcaactttcattaccatgagctcaagcacattgtgtttgtgggctctattgagtacctcaagcgggaatgggagacgcttcataacttccccaaagtgtccatattgcctggtacgccattaagtcgggctgatttaagggctgtcaacatcaacctctgtgacatgtgcgttatcctgtcagccaatcagaataatattgatgatacttcgctgcaggacaaggaatgcatcttggcgtcactcaacatcaaatctatgcagtttgatgacagcatcggagtcttgcaggctaattcccaagggttcacacctccaggaatggatagatcctctccagataacagcccagtgcacgggatgttacgtcaaccatccatcacaactggggtcaacatccccatcatcactgaactagtgaacgatactaatgttcagtttttggaccaagacgatgatgatgaccctgatacagaactgtacctcacgcagccctttgcctgtgggacagcatttgccgtcagtgtcctggactcactcatgagcgcgacgtacttcaatgacaatatcctcaccctgatacggaccctggtgaccggaggagccacgccggagctggaggctctgattgctgaggaaaacgcccttagaggtggctacagcaccccgcagacactggccaatagggaccgctgccgcgtggcccagttagctctgctcgatgggccatttgcggacttaggggatggtggttgttatggtgatctgttctgcaaagctctgaaaacatataatatgctttgttttggaatttaccggctgagagatgctcacctcagcacccccagtcagtgcacaaagaggtatgtcatcaccaacccgccctatgagtttgagctcgtgccgacggacctgatcttctgcttaatgcagtttgaccacaatgccggccagtcccgggccagcctgtcccattcctcccactcgtcgcagtcctccagcaagaagagctcctctgttcactccatcccatccacagcaaaccgacagaaccggcccaagtccagggagtcccgggacaaacagaagtacgtgcaggaagagcggctttgatatgtgtatccaccgccactgtgtgaaactgtatctgccactcatttccccagttggtgtttccaacaaagtaactttccctgttttcccctgtagtccccccctttttttttacacatatttgcatatgtatgatagtgtgcatgtggttgtcatttttatttcaccaccataaaacccttgagcacaacagcaaataagcagacggaccaaaagttatttatgattctgggggaaaaataacccaaaggcatgctccagacataaatagctcactgcaggaacgagttcacagattagaagggagcacttgtgatcaacgtcagttaggcagagcaagtttatttaatgtaaaagaaaagttgattctgatttatcaggattatcagggtgctttgggttttgattttgttgttgttgttgttttcctttctttctttttttatacacacaataagttagcacatgtttatttgaaacaagcaaccaaacagcaatgaaaacatattgattgtttccagt

SEQ ID NO: 170 - protein, 1012 aa, Homo sapiens
MAFNVFFLLYFGLRFIAANDKLWFWLEVNSVVDFFTVPPVFVSVYLNRSWLGLRFLRALRLIQFSEILQFLNILKTSNSIKLVNLLSIFISTWLTAAGFIHLVENSGDPWENFQNNQALTYWECVYLLMVTMSTVGYGDVYAKTTLGRLFMVFFILGGLAMFASYVPEIIELIGNRKKYGGSYSAVSGRKHIVVCGHITLESVSNFLKDFLHKDRDDVNVEIVFLHNISPNLELEALFKRHFTQVEFYQGSVLNPHDLARVKIESADACLILANKYCADPDAEDNIMRVISIKNYHPKIRIITQMLQYHNKAHLLNIPSWNWKEGDDAICLAELKLGFIAQSCLAQGLSTMLANLFSMRSFIKIEEDTWQKYYLEGVSNEMYTEYLSSAFVGLSFPTVCELCFVKLKLLMIAIEYKSANRESRILINPGNHLKIQEGTLGFFIASDAKEVKRAFFYCKACHDDITDPKRIKKCGCKRPKMSIYKRMRRACCFDCGRSDCSCMSGRVRGNVDTLERAFPLSSVSVNDCSTSFRAFEDEQPSTLSPKKKQRNGGMRNSPNTSPKLMRHDPLLIPGNDQIDNMDSNVKKYDSTGMFHWCAPKEIEKVILTRSEAAMTVLSGHVVVCIFGDVSSALIGLRNLVMPLRNFHYHELKHIVFVGSIEYLKREWETLHNFPKVSILPGTPLSRADLRAVNINLCDMCVILSANQNNIDDTSLQDKECILASLNIKSMQFDDSIGVLQANSQGFTPPGMDRSSPDNSPVHGMLRQPSITTGVNIPIITELVNDTNVQFLDQDDDDDPDTELYLTQPFACGTAFAVSVLDSLMSATYFNDNILTLIRTLVTGGATPELEALIAEENALRGGYSTPQTLANRDRCRVAQLALLDGPFADLGDGGCYGDLFCKALKTYNMLCFGIYRLRDAHLSTPSQCTKRYVITNPPYEFELVPTDLIFCLMQFDHNAGQSRASLSHSSHSSQSSSKKSSSVHSIPSTANRQNRPKSRESRDKQKYVQEERL

SEQ ID NO: 171 - DNA, 3681 bp, Homo sapiens
tttttcttcttcctgtctaatagcccaatagaatcctgccagaatttctacaaagatttcacattacagatcgacatggctttcaacgtgttcttccttctctacttcggcttgcggtttattgcagccaacgataaattgtggttctggctggaagtgaactctgtagtggatttcttcacggtgccccccgtgtttgtgtctgtgtacttaaacagaagttggcttggtttgagatttttaagagctctgagactgatacagttttcagaaattttgcagtttctgaatattcttaaaacaagtaattccatcaagctggtgaatctgctctccatatttatcagcacgtggctgactgcagccgggttcatccatttggtggagaattcaggggacccatgggaaaatttccaaaacaaccaggctctcacctactgggaatgtgtctatttactcatggtcacaatgtccaccgttggttatggggatgtttatgcaaaaaccacacttgggcgcctcttcatggtcttcttcatcctcgggggactggccatgtttgccagctacgtccctgaaatcatagagttaataggaaaccgcaagaaatacgggggctcctatagtgcggttagtggaagaaagcacattgtggtctgcggacacatcactctggagagtgtttccaacttcctgaaggactttctgcacaaggaccgggatgacgtcaatgtggagatcgtttttcttcacaacatctcccccaacctggagcttgaagctctgttcaaacgacattttactcaggtggaattttatcagggttccgtcctcaatccacatgatcttgcaagagtcaagatagagtcagcagatgcatgcctgatccttgccaacaagtactgcgctgacccggatgcggaggatgcctcgaatatcatgagagtaatctccataaagaactaccatccgaagataagaatcatcactcaaatgctgcagtatcacaacaaggcccatctgctaaacatcccgagctggaattggaaagaaggtgatgacgcaatctgcctcgcagagttgaagttgggcttcatagcccagagctgcctggctcaaggcctctccaccatgcttgccaacctcttctccatgaggtcattcataaagattgaggaagacacatggcagaaatactacttggaaggagtctcaaatgaaatgtacacagaatatctctccagtgccttcgtgggtctgtccttccctactgtttgtgagctgtgttttgtgaagctcaagctcctaatgatagccattgagtacaagtctgccaaccgagagagccgtatattaattaatcctggaaaccatcttaagatccaagaaggtactttaggatttttcatcgcaagtgatgccaaagaagttaaaagggcatttttttactgcaaggcctgtcatgatgacatcacagatcccaaaagaataaaaaaatgtggctgcaaacggcccaagatgtccatctacaagagaatgagacgggcatgttgttttgattgcggacgttctgagcgtgactgctcatgcatgtcaggccgtgtgcgtggtaacgtggacacccttgagagagccttcccactttcttctgtctctgttaatgattgctccaccagtttccgtgcctttgaagatgagcagccgtcaacactatcaccaaaaaaaaagcaacggaatggaggcatgcggaactcacccaacacctcgcctaagctgatgaggcatgaccccttgttaattcctggcaatgatcagattgacaacatggactccaatgtgaagaagtacgactctactgggatgtttcactggtgtgcacccaaggagatagagaaagtcatcctgactcgaagtgaagctgccatgaccgtcctgagtggccatgtcgtggtctgcatctttggcgacgtcagctcagccctgatcggcctccggaacctggtgatgccgctccgtgccagcaactttcattaccatgagctcaagcacattgtgtttgtgggctctattgagtacctcaagcgggaatgggagacgcttcataacttccccaaagtgtccatattgcctggtacgccattaagtcgggctgatttaagggctgtcaacatcaacctctgtgacatgtgcgttatcctgtcagccaatcagaataatattgatgatacttcgctgcaggacaaggaatgcatcttggcgtcactcaacatcaaatctatgcagtttgatgacagcatcggagtcttgcaggctaattcccaagggttcacacctccaggaatggatagatcctctccagataacagcccagtgcacgggatgttacgtcaaccatccatcacaactggggtcaacatccccatcatcactgaactagtgaacgatactaatgttcagtttttggaccaagacgatgatgatgaccctgatacagaactgtacctcacgcagccctttgcctgtgggacagcatttgccgtcagtgtcctggactcactcatgagcgcgacgtacttcaatgacaatatcctcaccctgatacggaccctggtgaccggaggagccacgccggagctggaggctctgattgctgaggaaaacgcccttagaggtggctacagcaccccgcagacactggccaatagggaccgctgccgcgtggcccagttagctctgctcgatgggccatttgcggacttaggggatggtggttgttatggtgatctgttctgcaaagctctgaaaacatataatatgctttgttttggaatttaccggctgagagatgctcacctcagcacccccagtcagtgcacaaagaggtatgtcatcaccaacccgccctatgagtttgagctcgtgccgacggacctgatcttctgcttaatgcagtttgaccacaatgccggccagtcccgggccagcctgtcccattcctcccactcgtcgcagtcctccagcaagaagagctcctctgttcactccatcccatccacagcaaaccgacagaaccggcccaagtccagggagtcccgggacaaacagaaaaaagaaatggtttacagatgaaccggataatgcctatcccagaaacattcaaatcaagcccatgagtacccacatggctaaccagatcaaccaatataaatccacaagcagcttgattccaccaatcagagaagttgaagatgaatgttgactcccaggagaccagaactatttttttaaagcctgacaaacttcataaatggtgatgtgacttttcttcttacatgctgaatcactggtggaaacgttaggataagcaagaattgccagaaaataaagtagacagatctttctctttgtctgccttgaatattgcttccatgtattttggaaaagaaaatgatttcatttataaatgaacatactaaaatagtcatgtatagcctctagcattttaaattatttttatttattagaaagaaaatatattttttcttttcattgtcaaatatcttccctatatctaaacaatgcaaaatctaaatgaataagtggtcagactccttaatgtgtttttctcttctttctctctttttctttgaggagaatgatggtcaccaccacaattaattg

SEQ ID NO: 172 - protein, 1011 aa, Homo sapiens
MAFNVFFLLYFGLRFIAANDKLWFWLEVNSVVDFFTVPPVFVSVYLNRSWLGLRFLRALRLIQFSEILQFLNILKTSNSIKLVNLLSIFISTWLTAAGFIHLVENSGDPWENFQNNQALTYWECVYLLMVTMSTVGYGDVYAKTTLGRLFMVFFILGGLAMFASYVPEIIELIGNRKKYGGSYSAVSGRKHIVVCGHITLESVSNFLKDFLHKDRDDVNVEIVFLHNISPNLELEALFKRHFTQVEFYQGSVLNPHDLARVKIESADACLILANKYCADPDAEDNIMRVISIKNYHPKIRIITQMLQYHNKAHLLNIPSWNWKEGDDAICLAELKLGFIAQSCLAQGLSTMLANLFSMRSFIKIEEDTWQKYYLEGVSNEMYTEYLSSAFVGLSFPTVCELCFVKLKLLMIAIEYKSANRESRILINPGNHLKIQEGTLGFFIASDAKEVKRAFFYCKACHDDITDPKRIKKCGCKRPKMSIYKRMRRACCFDCGRSDCSCMSGRVRGNVDTLERAFPLSSVSVNDCSTSFRAFEDEQPSTLSPKKKQRNGGMRNSPNTSPKLMRHDPLLIPGNDQIDNMDSNVKKYDSTGMFHWCAPKEIEKVILTRSEAAMTVLSGHVVVCIFGDVSSALIGLRNLVMPLRNFHYHELKHIVFVGSIEYLKREWETLHNFPKVSILPGTPLSRADLRAVNINLCDMCVILSANQNNIDDTSLQDKECILASLNIKSMQFDDSIGVLQANSQGFTPPGMDRSSPDNSPVHGMLRQPSITTGVNIPIITELVNDTNVQFLDQDDDDDPDTELYLTQPFACGTAFAVSVLDSLMSATYFNDNILTLIRTLVTGGATPELEALIAEENALRGGYSTPQTLANRDRCRVAQLALLDGPFADLGDGGCYGDLFCKALKTYNMLCFGIYRLRDAHLSTPSQCTKRYVITNPPYEFELVPTDLIFCLMQFDHNAGQSRASLSHSSHSSQSSSKKSSSVHSIPSTANRQNRPKSRESRDKQKKEMVYR

SEQ ID NO: 173 - DNA, 3480 bp, Homo sapiens
tttttcttcttcctgtctaatagcccaatagaatcctgccagaatttctacaaagatttcacattacagatcgacatggctttcaacgtgttcttccttctctacttcggcttgcggtttattgcagccaacgataaattgtggttctggctggaagtgaactctgtagtggatttcttcacggtgccccccgtgtttgtgtctgtgtacttaaacagaagttggcttggtttgagatttttaagagctctgagactgatacagttttcagaaattttgcagtttctgaatattcttaaaacaagtaattccatcaagctggtgaatctgctctccatatttatcagcacgtggctgactgcagccgggttcatccatttggtggagaattcaggggacccatgggaaaatttccaaaacaaccaggctctcacctactgggaatgtgtctatttactcatggtcacaatgtccaccgttggttatggggatgtttatgcaaaaaccacacttgggcgcctcttcatggtcttcttcatcctcgggggactggccatgtttgccagctacgtccctgaaatcatagagttaataggaaaccgcaagaaatacgggggctcctatagtgcggttagtggaagaaagcacattgtggtctgcggacacatcactctggagagtgtttccaacttcctgaaggactttctgcacaaggaccgggatgacgtcaatgtggagatcgtttttcttcacaacatctcccccaacctggagcttgaagctctgttcaaacgacattttactcaggtggaattttatcagggttccgtcctcaatccacatgatcttgcaagagtcaagatagagtcagcagatgcatgcctgatccttgccaacaagtactgcgctgacccggatgcggaggatgcctcgaatatcatgagagtaatctccataaagaactaccatccgaagataagaatcatcactcaaatgctgcagtatcacaacaaggcccatctgctaaacatcccgagctggaattggaaagaaggtgatgacgcaatctgcctcgcagagttgaagttgggcttcatagcccagagctgcctggctcaaggcctctccaccatgcttgccaacctcttctccatgaggtcattcataaagattgaggaagacacatggcagaaatactacttggaaggagtctcaaatgaaatgtacacagaatatctctccagtgccttcgtgggtctgtccttccctactgtttgtgagctgtgttttgtgaagctcaagctcctaatgatagccattgagtacaagtctgccaaccgagagagccgtatattaattaatcctggaaaccatcttaagatccaagaaggtactttaggatttttcatcgcaagtgatgccaaagaagttaaaagggcatttttttactgcaaggcctgtcatgatgacatcacagatcccaaaagaataaaaaaatgtggctgcaaacggcttgaagatgagcagccgtcaacactatcaccaaaaaaaaagcaacggaatggaggcatgcggaactcacccaacacctcgcctaagctgatgaggcatgaccccttgttaattcctggcaatgatcagattgacaacatggactccaatgtgaagaagtacgactctactgggatgtttcactggtgtgcacccaaggagatagagaaagtcatcctgactcgaagtgaagctgccatgaccgtcctgagtggccatgtcgtggtctgcatctttggcgacgtcagctcagccctgatcggcctccggaacctggtgatgccgctccgtgccagcaactttcattaccatgagctcaagcacattgtgtttgtgggctctattgagtacctcaagcgggaatgggagacgcttcataacttccccaaagtgtccatattgcctggtacgccattaagtcgggctgatttaagggctgtcaacatcaacctctgtgacatgtgcgttatcctgtcagccaatcagaataatattgatgatacttcgctgcaggacaaggaatgcatcttggcgtcactcaacatcaaatctatgcagtttgatgacagcatcggagtcttgcaggctaattcccaagggttcacacctccaggaatggatagatcctctccagataacagcccagtgcacgggatgttacgtcaaccatccatcacaactggggtcaacatccccatcatcactgaactagtgaacgatactaatgttcagtttttggaccaagacgatgatgatgaccctgatacagaactgtacctcacgcagccctttgcctgtgggacagcatttgccgtcagtgtcctggactcactcatgagcgcgacgtacttcaatgacaatatcctcaccctgatacggaccctggtgaccggaggagccacgccggagctggaggctctgattgctgaggaaaacgcccttagaggtggctacagcaccccgcagacactggccaatagggaccgctgccgcgtggcccagttagctctgctcgatgggccatttgcggacttaggggatggtggttgttatggtgatctgttctgcaaagctctgaaaacatataatatgctttgttttggaatttaccggctgagagatgctcacctcagcacccccagtcagtgcacaaagaggtatgtcatcaccaacccgccctatgagtttgagctcgtgccgacggacctgatcttctgcttaatgcagtttgaccacaatgccggccagtcccgggccagcctgtcccattcctcccactcgtcgcagtcctccagcaagaagagctcctctgttcactccatcccatccacagcaaaccgacagaaccggcccaagtccagggagtcccgggacaaacagaagtacgtgcaggaagagcggctttgatatgtgtatccaccgccactgtgtgaaactgtatctgccactcatttccccagttggtgtttccaacaaagtaactttccctgttttcccctgtagtccccccctttttttttacacatatttgcatatgtatgatagtgtgcatgtggttgtcatttttatttcaccaccataaaacccttgagcacaacagcaaataagcagacggaccaaaagttatttatgattctgggggaaaaataacccaaaggcatgctccagacataaatagctcactgcaggaacgagttcacagattagaagggagcacttgtgatcaacgtcagttaggcagagcaagtttatttaatgtaaaagaaaagttgattctgatttatcaggattatcagggtgctttgggttttgattttgttgttgttgttgttttcctttctttctttttttatacacacaataagttagcacatgtttatttgaaacaagcaaccaaacagcaatgaaaacatattgattgtttccagt

SEQ ID NO: 174 - protein, 956 aa, Homo sapiens
MAFNVFFLLYFGLRFIAANDKLWFWLEVNSVVDFFTVPPVFVSVYLNRSWLGLRFLRALRLIQFSEILQFLNILKTSNSIKLVNLLSIFISTWLTAAGFIHLVENSGDPWENFQNNQALTYWECVYLLMVTMSTVGYGDVYAKTTLGRLFMVFFILGGLAMFASYVPEIIELIGNRKKYGGSYSAVSGRKHIVVCGHITLESVSNFLKDFLHKDRDDVNVEIVFLHNISPNLELEALFKRHFTQVEFYQGSVLNPHDLARVKIESADACLILANKYCADPDAEDNIMRVISIKNYHPKIRIITQMLQYHNKAHLLNIPSWNWKEGDDAICLAELKLGFIAQSCLAQGLSTMLANLFSMRSFIKIEEDTWQKYYLEGVSNEMYTEYLSSAFVGLSFPTVCELCFVKLKLLMIAIEYKSANRESRILINPGNHLKIQEGTLGFFIASDAKEVKRAFFYCKACHDDITDPKRIKKCGCKRLEDEQPSTLSPKKKQRNGGMRNSPNTSPKLMRHDPLLIPGNDQIDNMDSNVKKYDSTGMFHWCAPKEIEKVILTRSEAAMTVLSGHVVVCIFGDVSSALIGLRNLVMPLRNFHYHELKHIVFVGSIEYLKREWETLHNFPKVSILPGTPLSRADLRAVNINLCDMCVILSANQNNIDDTSLQDKECILASLNIKSMQFDDSIGVLQANSQGFTPPGMDRSSPDNSPVHGMLRQPSITTGVNIPIITELVNDTNVQFLDQDDDDDPDTELYLTQPFACGTAFAVSVLDSLMSATYFNDNILTLIRTLVTGGATPELEALIAEENALRGGYSTPQTLANRDRCRVAQLALLDGPFADLGDGGCYGDLFCKALKTYNMLCFGIYRLRDAHLSTPSQCTKRYVITNPPYEFELVPTDLIFCLMQFDHNAGQSRASLSHSSHSSQSSSKKSSSVHSIPSTANRQNRPKSRESRDKQKYVQEERL

SEQ ID NO: 175 - DNA, 3539 bp, Homo sapiens
tttttcttcttcctgtctaatagcccaatagaatcctgccagaatttctacaaagatttcacattacagatcgacatggctttcaacgtgttcttccttctctacttcggcttgcggtttattgcagccaacgataaattgtggttctggctggaagtgaactctgtagtggatttcttcacggtgccccccgtgtttgtgtctgtgtacttaaacagaagttggcttggtttgagatttttaagagctctgagactgatacagttttcagaaattttgcagtttctgaatattcttaaaacaagtaattccatcaagctggtgaatctgctctccatatttatcagcacgtggctgactgcagccgggttcatccatttggtggagaattcaggggacccatgggaaaatttccaaaacaaccaggctctcacctactgggaatgtgtctatttactcatggtcacaatgtccaccgttggttatggggatgtttatgcaaaaaccacacttgggcgcctcttcatggtcttcttcatcctcgggggactggccatgtttgccagctacgtccctgaaatcatagagttaataggaaaccgcaagaaatacgggggctcctatagtgcggttagtggaagaaagcacattgtggtctgcggacacatcactctggagagtgtttccaacttcctgaaggactttctgcacaaggaccgggatgacgtcaatgtggagatcgtttttcttcacaacatctcccccaacctggagcttgaagctctgttcaaacgacattttactcaggtggaattttatcagggttccgtcctcaatccacatgatcttgcaagagtcaagatagagtcagcagatgcatgcctgatccttgccaacaagtactgcgctgacccggatgcggaggatgcctcgaatatcatgagagtaatctccataaagaactaccatccgaagataagaatcatcactcaaatgctgcagtatcacaacaaggcccatctgctaaacatcccgagctggaattggaaagaaggtgatgacgcaatctgcctcgcagagttgaagttgggcttcatagcccagagctgcctggctcaaggcctctccaccatgcttgccaacctcttctccatgaggtcattcataaagattgaggaagacacatggcagaaatactacttggaaggagtctcaaatgaaatgtacacagaatatctctccagtgccttcgtgggtctgtccttccctactgtttgtgagctgtgttttgtgaagctcaagctcctaatgatagccattgagtacaagtctgccaaccgagagagccgtatattaattaatcctggaaaccatcttaagatccaagaaggtactttaggatttttcatcgcaagtgatgccaaagaagttaaaagggcatttttttactgcaaggcctgtcatgatgacatcacagatcccaaaagaataaaaaaatgtggctgcaaacggcttgaagatgagcagccgtcaacactatcaccaaaaaaaaagcaacggaatggaggcatgcggaactcacccaacacctcgcctaagctgatgaggcatgaccccttgttaattcctggcaatgatcagattgacaacatggactccaatgtgaagaagtacgactctactgggatgtttcactggtgtgcacccaaggagatagagaaagtcatcctgactcgaagtgaagctgccatgaccgtcctgagtggccatgtcgtggtctgcatctttggcgacgtcagctcagccctgatcggcctccggaacctggtgatgccgctccgtgccagcaactttcattaccatgagctcaagcacattgtgtttgtgggctctattgagtacctcaagcgggaatgggagacgcttcataacttccccaaagtgtccatattgcctggtacgccattaagtcgggctgatttaagggctgtcaacatcaacctctgtgacatgtgcgttatcctgtcagccaatcagaataatattgatgatacttcgctgcaggacaaggaatgcatcttggcgtcactcaacatcaaatctatgcagtttgatgacagcatcggagtcttgcaggctaattcccaagggttcacacctccaggaatggatagatcctctccagataacagcccagtgcacgggatgttacgtcaaccatccatcacaactggggtcaacatccccatcatcactgaactagtgaacgatactaatgttcagtttttggaccaagacgatgatgatgaccctgatacagaactgtacctcacgcagccctttgcctgtgggacagcatttgccgtcagtgtcctggactcactcatgagcgcgacgtacttcaatgacaatatcctcaccctgatacggaccctggtgaccggaggagccacgccggagctggaggctctgattgctgaggaaaacgcccttagaggtggctacagcaccccgcagacactggccaatagggaccgctgccgcgtggcccagttagctctgctcgatgggccatttgcggacttaggggatggtggttgttatggtgatctgttctgcaaagctctgaaaacatataatatgctttgttttggaatttaccggctgagagatgctcacctcagcacccccagtcagtgcacaaagaggtatgtcatcaccaacccgccctatgagtttgagctcgtgccgacggacctgatcttctgcttaatgcagtttgaccacaatgccggccagtcccgggccagcctgtcccattcctcccactcgtcgcagtcctccagcaagaagagctcctctgttcactccatcccatccacagcaaaccgacagaaccggcccaagtccagggagtcccgggacaaacagaatgcaacaaggatgaatagaatgggccaagcagaaaagaaatggtttacagatgaaccggataatgcctatcccagaaacattcaaatcaagcccatgagtacccacatggctaaccagatcaaccaatataaatccacaagcagcttgattccaccaatcagagaagttgaagatgaatgttgactcccaggagaccagaactatttttttaaagcctgacaaacttcataaatggtgatgtgacttttcttcttacatgctgaatcactggtggaaacgttaggataagcaagaattgccagaaaataaagtagacagatctttctctttgtctgccttgaatattgcttccatgtattttggaaaagaaaatgatttcatttataaatgaacatactaaaatagtcatgtatagcctctagcattttaaattatttttatttattagaaagaaaatatattttttcttttcattgtcaaatatcttccctatatctaaacaatgcaaaatctaaatgaataagtggtcagactccttaatgtgtttttctcttctttctctctttttctttgaggagaatgatggtcaccaccacaattaattg

SEQ ID NO: 176 - protein, 1009 aa, Homo sapiens
MAFNVFFLLYFGLRFIAANDKLWFWLEVNSVVDFFTVPPVFVSVYLNRSWLGLRFLRALRLIQFSEILQFLNILKTSNSIKLVNLLSIFISTWLTAAGFIHLVENSGDPWENFQNNQALTYWECVYLLMVTMSTVGYGDVYAKTTLGRLFMVFFILGGLAMFASYVPEIIELIGNRKKYGGSYSAVSGRKHIVVCGHITLESVSNFLKDFLHKDRDDVNVEIVFLHNISPNLELEALFKRHFTQVEFYQGSVLNPHDLARVKIESADACLILANKYCADPDAEDNIMRVISIKNYHPKIRIITQMLQYHNKAHLLNIPSWNWKEGDDAICLAELKLGFIAQSCLAQGLSTMLANLFSMRSFIKIEEDTWQKYYLEGVSNEMYTEYLSSAFVGLSFPTVCELCFVKLKLLMIAIEYKSANRESRILINPGNHLKIQEGTLGFFIASDAKEVKRAFFYCKACHDDITDPKRIKKCGCKRLEDEQPSTLSPKKKQRNGGMRNSPNTSPKLMRHDPLLIPGNDQIDNMDSNVKKYDSTGMFHWCAPKEIEKVILTRSEAAMTVLSGHVVVCIFGDVSSALIGLRNLVMPLRNFHYHELKHIVFVGSIEYLKREWETLHNFPKVSILPGTPLSRADLRAVNINLCDMCVILSANQNNIDDTSLQDKECILASLNIKSMQFDDSIGVLQANSQGFTPPGMDRSSPDNSPVHGMLRQPSITTGVNIPIITELVNDTNVQFLDQDDDDDPDTELYLTQPFACGTAFAVSVLDSLMSATYFNDNILTLIRTLVTGGATPELEALIAEENALRGGYSTPQTLANRDRCRVAQLALLDGPFADLGDGGCYGDLFCKALKTYNMLCFGIYRLRDAHLSTPSQCTKRYVITNPPYEFELVPTDLIFCLMQFDHNAGQSRASLSHSSHSSQSSSKKSSSVHSIPSTANRQNRPKSRESRDKQNATRMNRMGQAEKKWFTDEPDNAYPRNIQIKPMSTHMANQINQYKSTSSLIPPIREVEDEC

SEQ ID NO: 177 - DNA, 3588 bp, Homo sapiens
tttttcttcttcctgtctaatagcccaatagaatcctgccagaatttctacaaagatttcacattacagatcgacatggctttcaacgtgttcttccttctctacttcggcttgcggtttattgcagccaacgataaattgtggttctggctggaagtgaactctgtagtggatttcttcacggtgccccccgtgtttgtgtctgtgtacttaaacagaagttggcttggtttgagatttttaagagctctgagactgatacagttttcagaaattttgcagtttctgaatattcttaaaacaagtaattccatcaagctggtgaatctgctctccatatttatcagcacgtggctgactgcagccgggttcatccatttggtggagaattcaggggacccatgggaaaatttccaaaacaaccaggctctcacctactgggaatgtgtctatttactcatggtcacaatgtccaccgttggttatggggatgtttatgcaaaaaccacacttgggcgcctcttcatggtcttcttcatcctcgggggactggccatgtttgccagctacgtccctgaaatcatagagttaataggaaaccgcaagaaatacgggggctcctatagtgcggttagtggaagaaagcacattgtggtctgcggacacatcactctggagagtgtttccaacttcctgaaggactttctgcacaaggaccgggatgacgtcaatgtggagatcgtttttcttcacaacatctcccccaacctggagcttgaagctctgttcaaacgacattttactcaggtggaattttatcagggttccgtcctcaatccacatgatcttgcaagagtcaagatagagtcagcagatgcatgcctgatccttgccaacaagtactgcgctgacccggatgcggaggatgcctcgaatatcatgagagtaatctccataaagaactaccatccgaagataagaatcatcactcaaatgctgcagtatcacaacaaggcccatctgctaaacatcccgagctggaattggaaagaaggtgatgacgcaatctgcctcgcagagttgaagttgggcttcatagcccagagctgcctggctcaaggcctctccaccatgcttgccaacctcttctccatgaggtcattcataaagattgaggaagacacatggcagaaatactacttggaaggagtctcaaatgaaatgtacacagaatatctctccagtgccttcgtgggtctgtccttccctactgtttgtgagctgtgttttgtgaagctcaagctcctaatgatagccattgagtacaagtctgccaaccgagagagccgtatattaattaatcctggaaaccatcttaagatccaagaaggtactttaggatttttcatcgcaagtgatgccaaagaagttaaaagggcatttttttactgcaaggcctgtcatgatgacatcacagatcccaaaagaataaaaaaatgtggctgcaaacggcttgaagatgagcagccgtcaacactatcaccaaaaaaaaagcaacggaatggaggcatgcggaactcacccaacacctcgcctaagctgatgaggcatgaccccttgttaattcctggcaatgatcagattgacaacatggactccaatgtgaagaagtacgactctactgggatgtttcactggtgtgcacccaaggagatagagaaagtcatcctgactcgaagtgaagctgccatgaccgtcctgagtggccatgtcgtggtctgcatctttggcgacgtcagctcagccctgatcggcctccggaacctggtgatgccgctccgtgccagcaactttcattaccatgagctcaagcacattgtgtttgtgggctctattgagtacctcaagcgggaatgggagacgcttcataacttccccaaagtgtccatattgcctggtacgccattaagtcgggctgatttaagggctgtcaacatcaacctctgtgacatgtgcgttatcctgtcagccaatcagaataatattgatgatacttcgctgcaggacaaggaatgcatcttggcgtcactcaacatcaaatctatgcagtttgatgacagcatcggagtcttgcaggctaattcccaagggttcacacctccaggaatggatagatcctctccagataacagcccagtgcacgggatgttacgtcaaccatccatcacaactggggtcaacatccccatcatcactgaactagctaaaccgggcaagttgcctttggtatcagtcaatcaggaaaaaaacagtgggacgcacattctaatgataactgaactggtgaacgatactaatgttcagtttttggaccaagacgatgatgatgaccctgatacagaactgtacctcacgcagccctttgcctgtgggacagcatttgccgtcagtgtcctggactcactcatgagcgcgacgtacttcaatgacaatatcctcaccctgatacggaccctggtgaccggaggagccacgccggagctggaggctctgattgctgaggaaaacgcccttagaggtggctacagcaccccgcagacactggccaatagggaccgctgccgcgtggcccagttagctctgctcgatgggccatttgcggacttaggggatggtggttgttatggtgatctgttctgcaaagctctgaaaacatataatatgctttgttttggaatttaccggctgagagatgctcacctcagcacccccagtcagtgcacaaagaggtatgtcatcaccaacccgccctatgagtttgagctcgtgccgacggacctgatcttctgcttaatgcagtttgaccacaatgccggccagtcccgggccagcctgtcccattcctcccactcgtcgcagtcctccagcaagaagagctcctctgttcactccatcccatccacagcaaaccgacagaaccggcccaagtccagggagtcccgggacaaacagaaaaaagaaatggtttacagatgaaccggataatgcctatcccagaaacattcaaatcaagcccatgagtacccacatggctaaccagatcaaccaatataaatccacaagcagcttgattccaccaatcagagaagttgaagatgaatgttgactcccaggagaccagaactatttttttaaagcctgacaaacttcataaatggtgatgtgacttttcttcttacatgctgaatcactggtggaaacgttaggataagcaagaattgccagaaaataaagtagacagatctttctctttgtctgccttgaatattgcttccatgtattttggaaaagaaaatgatttcatttataaatgaacatactaaaatagtcatgtatagcctctagcattttaaattatttttatttattagaaagaaaatatattttttcttttcattgtcaaatatcttccctatatctaaacaatgcaaaatctaaatgaataagtggtcagactccttaatgtgtttttctcttctttctctctttttctttgaggagaatgatggtcaccaccacaattaattg

SEQ ID NO: 178 - protein, 982 aa, Homo sapiens
MAFNVFFLLYFGLRFIAANDKLWFWLEVNSVVDFFTVPPVFVSVYLNRSWLGLRFLRALRLIQFSEILQFLNILKTSNSIKLVNLLSIFISTWLTAAGFIHLVENSGDPWENFQNNQALTYWECVYLLMVTMSTVGYGDVYAKTTLGRLFMVFFILGGLAMFASYVPEIIELIGNRKKYGGSYSAVSGRKHIVVCGHITLESVSNFLKDFLHKDRDDVNVEIVFLHNISPNLELEALFKRHFTQVEFYQGSVLNPHDLARVKIESADACLILANKYCADPDAEDNIMRVISIKNYHPKIRIITQMLQYHNKAHLLNIPSWNWKEGDDAICLAELKLGFIAQSCLAQGLSTMLANLFSMRSFIKIEEDTWQKYYLEGVSNEMYTEYLSSAFVGLSFPTVCELCFVKLKLLMIAIEYKSANRESRILINPGNHLKIQEGTLGFFIASDAKEVKRAFFYCKACHDDITDPKRIKKCGCKRLEDEQPSTLSPKKKQRNGGMRNSPNTSPKLMRHDPLLIPGNDQIDNMDSNVKKYDSTGMFHWCAPKEIEKVILTRSEAAMTVLSGHVVVCIFGDVSSALIGLRNLVMPLRNFHYHELKHIVFVGSIEYLKREWETLHNFPKVSILPGTPLSRADLRAVNINLCDMCVILSANQNNIDDTSLQDKECILASLNIKSMQFDDSIGVLQANSQGFTPPGMDRSSPDNSPVHGMLRQPSITTGVNIPIITELAKPGKLPLVSVNQEKNSGTHILMITELVNDTNVQFLDQDDDDDPDTELYLTQPFACGTAFAVSVLDSLMSATYFNDNILTLIRTLVTGGATPELEALIAEENALRGGYSTPQTLANRDRCRVAQLALLDGPFADLGDGGCYGDLFCKALKTYNMLCFGIYRLRDAHLSTPSQCTKRYVITNPPYEFELVPTDLIFCLMQFDHNAGQSRASLSHSSHSSQSSSKKSSSVHSIPSTANRQNRPKSRESRDKQKKEMVYR

SEQ ID NO: 179 - DNA, 5099 bp, Homo sapiens
ccgggccgctgccgaggggccctgcccacccctgcccagcccggagcccaggcgagccagcgcggcgagcctcctcccctcccgcctgggtcgtcctgagtccgcgcccgctccagttgctgcagctgctgctgctggcggctgcggggagcgcggggcgcgcgccgaagaggcttgggcggcgaggacggggacgaggaggagtcggaggcggcaaggaggaagagcgagcggaggccgaggggctcagcggcgtggcgacaggactagggggtcccgagaacatgggctagcaggcggccacgggccggcggccggacgcggtgaacctgccgcggccgggcgcgcactggcgcggcgagccggagccgagcgcagccgggggaggagggctggcgcaggggcgcccgggcggagggggccgattatccattattaacgagttaccacctaataagcggagagcggctcgttagccgcgcgggaggcgctcggggaagggggtcaccggccgagcgcagcgcacacccgtggcgcacggcgggcggcgcggcgccgaggacacccgggaccgcgcgcggagccggggcgggcccgggggcggcgcagaccccgggcgcgggcggcccgcggcgccccctggctctcggcgctcggggccagcgcagcccggggcgagtggggcgcgggccggggagggggagctgcccgcgcactccatccccctcccccccgggcgggcggcggcggctcgctgtatatatctcggcgcaccccgccaggtcgcgcacagcgccccgagcccaggcgcctccccgcccccctcccgcgctccgcggcggcggcggcggcggcagcagtagcagcaatatggctgttgatgggtgtttggggtggcgctggcggcgggaggagctcccccgagcccctgcgccggctgcccgttgctagctatggcaaatggtggcggcggcggcggcggcagcagcggcggcggcggcggcggcggaggcagcagtcttagaatgagtagcaatatccacgcgaaccatctcagcctagacgcgtcctcctcctcctcctcctcctcttcctcttcttcttcttcctcctcctcttcctcctcgtcctcggtccacgagcccaagatggatgcgctcatcatcccggtgaccatggaggtgccgtgcgacagccggggccaacgcatgtggtgggctttcctggcctcctccatggtgactttcttcgggggcctcttcatcatcttgctctggcggacgctcaagtacctgtggaccgtgtgctgccactgcgggggcaagacgaaggaggcccagaagattaacaatggctcaagccaggcggatggcactctcaaaccagtggatgaaaaagaggaggcagtggccgccgaggtcggctggatgacctccgtgaaggactgggcgggggtgatgatatccgcccagacactgactggcagagtcctggttgtcttagtctttgctctcagcatcggtgcacttgtaatatacttcatagattcatcaaacccaatagaatcctgccagaatttctacaaagatttcacattacagatcgacatggctttcaacgtgttcttccttctctacttcggcttgcggtttattgcagccaacgataaattgtggttctggctggaagtgaactctgtagtggatttcttcacggtgccccccgtgtttgtgtctgtgtacttaaacagaagttggcttggtttgagatttttaagagctctgagactgatacagttttcagaaattttgcagtttctgaatattcttaaaacaagtaattccatcaagctggtgaatctgctctccatatttatcagcacgtggctgactgcagccgggttcatccatttggtggagaattcaggggacccatgggaaaatttccaaaacaaccaggctctcacctactgggaatgtgtctatttactcatggtcacaatgtccaccgttggttatggggatgtttatgcaaaaaccacacttgggcgcctcttcatggtcttcttcatcctcgggggactggccatgtttgccagctacgtccctgaaatcatagagttaataggaaaccgcaagaaatacgggggctcctatagtgcggttagtggaagaaagcacattgtggtctgcggacacatcactctggagagtgtttccaacttcctgaaggactttctgcacaaggaccgggatgacgtcaatgtggagatcgtttttcttcacaacatctcccccaacctggagcttgaagctctgttcaaacgacattttactcaggtggaattttatcagggttccgtcctcaatccacatgatcttgcaagagtcaagatagagtcagcagatgcatgcctgatccttgccaacaagtactgcgctgacccggatgcggaggatgcctcgaatatcatgagagtaatctccataaagaactaccatccgaagataagaatcatcactcaaatgctgcagtatcacaacaaggcccatctgctaaacatcccgagctggaattggaaagaaggtgatgacgcaatctgcctcgcagagttgaagttgggcttcatagcccagagctgcctggctcaaggcctctccaccatgcttgccaacctcttctccatgaggtcattcataaagattgaggaagacacatggcagaaatactacttggaaggagtctcaaatgaaatgtacacagaatatctctccagtgccttcgtgggtctgtccttccctactgtttgtgagctgtgttttgtgaagctcaagctcctaatgatagccattgagtacaagtctgccaaccgagagagccgtatattaattaatcctggaaaccatcttaagatccaagaaggtactttaggatttttcatcgcaagtgatgccaaagaagttaaaagggcatttttttactgcaaggcctgtcatgatgacatcacagatcccaaaagaataaaaaaatgtggctgcaaacggctcaaggttgcagctagatcacgctattccaaagatccatttgagttcaagaaggagactcccaattctcggcttgtgaccgagccagttgaagatgagcagccgtcaacactatcaccaaaaaaaaagcaacggaatggaggcatgcggaactcacccaacacctcgcctaagctgatgaggcatgaccccttgttaattcctggcaatgatcagattgacaacatggactccaatgtgaagaagtacgactctactgggatgtttcactggtgtgcacccaaggagatagagaaagtcatcctgactcgaagtgaagctgccatgaccgtcctgagtggccatgtcgtggtctgcatctttggcgacgtcagctcagccctgatcggcctccggaacctggtgatgccgctccgtgccagcaactttcattaccatgagctcaagcacattgtgtttgtgggctctattgagtacctcaagcgggaatgggagacgcttcataacttccccaaagtgtccatattgcctggtacgccattaagtcgggctgatttaagggctgtcaacatcaacctctgtgacatgtgcgttatcctgtcagccaatcagaataatattgatgatacttcgctgcaggacaaggaatgcatcttggcgtcactcaacatcaaatctatgcagtttgatgacagcatcggagtcttgcaggctaattcccaagggttcacacctccaggaatggatagatcctctccagataacagcccagtgcacgggatgttacgtcaaccatccatcacaactggggtcaacatccccatcatcactgaactagtgaacgatactaatgttcagtttttggaccaagacgatgatgatgaccctgatacagaactgtacctcacgcagccctttgcctgtgggacagcatttgccgtcagtgtcctggactcactcatgagcgcgacgtacttcaatgacaatatcctcaccctgatacggaccctggtgaccggaggagccacgccggagctggaggctctgattgctgaggaaaacgcccttagaggtggctacagcaccccgcagacactggccaatagggaccgctgccgcgtggcccagttagctctgctcgatgggccatttgcggacttaggggatggtggttgttatggtgatctgttctgcaaagctctgaaaacatataatatgctttgttttggaatttaccggctgagagatgctcacctcagcacccccagtcagtgcacaaagaggtatgtcatcaccaacccgccctatgagtttgagctcgtgccgacggacctgatcttctgcttaatgcagtttgaccacaatgccggccagtcccgggccagcctgtcccattcctcccactcgtcgcagtcctccagcaagaagagctcctctgttcactccatcccatccacagcaaaccgacagaaccggcccaagtccagggagtcccgggacaaacagaagtacgtgcaggaagagcggctttgatatgtgtatccaccgccactgtgtgaaactgtatctgccactcatttccccagttggtgtttccaacaaagtaactttccctgttttcccctgtagtccccccctttttttttacacatatttgcatatgtatgatagtgtgcatgtggttgtcatttttatttcaccaccataaaacccttgagcacaacagcaaataagcagacggaccaaaagttatttatgattctgggggaaaaataacccaaaggcatgctccagacataaatagctcactgcaggaacgagttcacagattagaagggagcacttgtgatcaacgtcagttaggcagagcaagtttatttaatgtaaaagaaaagttgattctgatttatcaggattatcagggtgctttgggttttgattttgttgttgttgttgttttcctttctttctttttttatacacacaataagttagcacatgtttatttgaaacaagcaaccaaacagcaatgaaaacatattgattgtttccagt

SEQ ID NO: 180 - protein, 1203 aa, Homo sapiens
MANGGGGGGGSSGGGGGGGGSSLRMSSNIHANHLSLDASSSSSSSSSSSSSSSSSSSSSSVHEPKMDALIIPVTMEVPCDSRGQRMWWAFLASSMVTFFGGLFIILLWRTLKYLWTVCCHCGGKTKEAQKINNGSSQADGTLKPVDEKEEAVAAEVGWMTSVKDWAGVMISAQTLTGRVLVVLVFALSIGALVIYFIDSSNPIESCQNFYKDFTLQIDMAFNVFFLLYFGLRFIAANDKLWFWLEVNSVVDFFTVPPVFVSVYLNRSWLGLRFLRALRLIQFSEILQFLNILKTSNSIKLVNLLSIFISTWLTAAGFIHLVENSGDPWENFQNNQALTYWECVYLLMVTMSTVGYGDVYAKTTLGRLFMVFFILGGLAMFASYVPEIIELIGNRKKYGGSYSAVSGRKHIVVCGHITLESVSNFLKDFLHKDRDDVNVEIVFLHNISPNLELEALFKRHFTQVEFYQGSVLNPHDLARVKIESADACLILANKYCADPDAEDNIMRVISIKNYHPKIRIITQMLQYHNKAHLLNIPSWNWKEGDDAICLAELKLGFIAQSCLAQGLSTMLANLFSMRSFIKIEEDTWQKYYLEGVSNEMYTEYLSSAFVGLSFPTVCELCFVKLKLLMIAIEYKSANRESRILINPGNHLKIQEGTLGFFIASDAKEVKRAFFYCKACHDDITDPKRIKKCGCKRLKVAARSRYSKDPFEFKKETPNSRLVTEPVEDEQPSTLSPKKKQRNGGMRNSPNTSPKLMRHDPLLIPGNDQIDNMDSNVKKYDSTGMFHWCAPKEIEKVILTRSEAAMTVLSGHVVVCIFGDVSSALIGLRNLVMPLRNFHYHELKHIVFVGSIEYLKREWETLHNFPKVSILPGTPLSRADLRAVNINLCDMCVILSANQNNIDDTSLQDKECILASLNIKSMQFDDSIGVLQANSQGFTPPGMDRSSPDNSPVHGMLRQPSITTGVNIPIITELVNDTNVQFLDQDDDDDPDTELYLTQPFACGTAFAVSVLDSLMSATYFNDNILTLIRTLVTGGATPELEALIAEENALRGGYSTPQTLANRDRCRVAQLALLDGPFADLGDGGCYGDLFCKALKTYNMLCFGIYRLRDAHLSTPSQCTKRYVITNPPYEFELVPTDLIFCLMQFDHNAGQSRASLSHSSHSSQSSSKKSSSVHSIPSTANRQNRPKSRESRDKQKYVQEERL

SEQ ID NO: 181 - DNA, 5186 bp, Homo sapiens
ccgggccgctgccgaggggccctgcccacccctgcccagcccggagcccaggcgagccagcgcggcgagcctcctcccctcccgcctgggtcgtcctgagtccgcgcccgctccagttgctgcagctgctgctgctggcggctgcggggagcgcggggcgcgcgccgaagaggcttgggcggcgaggacggggacgaggaggagtcggaggcggcaaggaggaagagcgagcggaggccgaggggctcagcggcgtggcgacaggactagggggtcccgagaacatgggctagcaggcggccacgggccggcggccggacgcggtgaacctgccgcggccgggcgcgcactggcgcggcgagccggagccgagcgcagccgggggaggagggctggcgcaggggcgcccgggcggagggggccgattatccattattaacgagttaccacctaataagcggagagcggctcgttagccgcgcgggaggcgctcggggaagggggtcaccggccgagcgcagcgcacacccgtggcgcacggcgggcggcgcggcgccgaggacacccgggaccgcgcgcggagccggggcgggcccgggggcggcgcagaccccgggcgcgggcggcccgcggcgccccctggctctcggcgctcggggccagcgcagcccggggcgagtggggcgcgggccggggagggggagctgcccgcgcactccatccccctcccccccgggcgggcggcggcggctcgctgtatatatctcggcgcaccccgccaggtcgcgcacagcgccccgagcccaggcgcctccccgcccccctcccgcgctccgcggcggcggcggcggcggcagcagtagcagcaatatggctgttgatgggtgtttggggtggcgctggcggcgggaggagctcccccgagcccctgcgccggctgcccgttgctagctatggcaaatggtggcggcggcggcggcggcagcagcggcggcggcggcggcggcggaggcagcagtcttagaatgagtagcaatatccacgcgaaccatctcagcctagacgcgtcctcctcctcctcctcctcctcttcctcttcttcttcttcctcctcctcttcctcctcgtcctcggtccacgagcccaagatggatgcgctcatcatcccggtgaccatggaggtgccgtgcgacagccggggccaacgcatgtggtgggctttcctggcctcctccatggtgactttcttcgggggcctcttcatcatcttgctctggcggacgctcaagtacctgtggaccgtgtgctgccactgcgggggcaagacgaaggaggcccagaagattaacaatggctcaagccaggcggatggcactctcaaaccagtggatgaaaaagaggaggcagtggccgccgaggtcggctggatgacctccgtgaaggactgggcgggggtgatgatatccgcccagacactgactggcagagtcctggttgtcttagtctttgctctcagcatcggtgcacttgtaatatacttcatagattcatcaaacccaatagaatcctgccagaatttctacaaagatttcacattacagatcgacatggctttcaacgtgttcttccttctctacttcggcttgcggtttattgcagccaacgataaattgtggttctggctggaagtgaactctgtagtggatttcttcacggtgccccccgtgtttgtgtctgtgtacttaaacagaagttggcttggtttgagatttttaagagctctgagactgatacagttttcagaaattttgcagtttctgaatattcttaaaacaagtaattccatcaagctggtgaatctgctctccatatttatcagcacgtggctgactgcagccgggttcatccatttggtggagaattcaggggacccatgggaaaatttccaaaacaaccaggctctcacctactgggaatgtgtctatttactcatggtcacaatgtccaccgttggttatggggatgtttatgcaaaaaccacacttgggcgcctcttcatggtcttcttcatcctcgggggactggccatgtttgccagctacgtccctgaaatcatagagttaataggaaaccgcaagaaatacgggggctcctatagtgcggttagtggaagaaagcacattgtggtctgcggacacatcactctggagagtgtttccaacttcctgaaggactttctgcacaaggaccgggatgacgtcaatgtggagatcgtttttcttcacaacatctcccccaacctggagcttgaagctctgttcaaacgacattttactcaggtggaattttatcagggttccgtcctcaatccacatgatcttgcaagagtcaagatagagtcagcagatgcatgcctgatccttgccaacaagtactgcgctgacccggatgcggaggatgcctcgaatatcatgagagtaatctccataaagaactaccatccgaagataagaatcatcactcaaatgctgcagtatcacaacaaggcccatctgctaaacatcccgagctggaattggaaagaaggtgatgacgcaatctgcctcgcagagttgaagttgggcttcatagcccagagctgcctggctcaaggcctctccaccatgcttgccaacctcttctccatgaggtcattcataaagattgaggaagacacatggcagaaatactacttggaaggagtctcaaatgaaatgtacacagaatatctctccagtgccttcgtgggtctgtccttccctactgtttgtgagctgtgttttgtgaagctcaagctcctaatgatagccattgagtacaagtctgccaaccgagagagccgtatattaattaatcctggaaaccatcttaagatccaagaaggtactttaggatttttcatcgcaagtgatgccaaagaagttaaaagggcatttttttactgcaaggcctgtcatgatgacatcacagatcccaaaagaataaaaaaatgtggctgcaaacggcccaagatgtccatctacaagagaatgagacgggcatgttgttttgattgcggacgttctgagcgtgactgctcatgcatgtcaggccgtgtgcgtggtaacgtggacacccttgagagagccttcccactttcttctgtctctgttaatgattgctccaccagtttccgtgcctttgaagatgagcagccgtcaacactatcaccaaaaaaaaagcaacggaatggaggcatgcggaactcacccaacacctcgcctaagctgatgaggcatgaccccttgttaattcctggcaatgatcagattgacaacatggactccaatgtgaagaagtacgactctactgggatgtttcactggtgtgcacccaaggagatagagaaagtcatcctgactcgaagtgaagctgccatgaccgtcctgagtggccatgtcgtggtctgcatctttggcgacgtcagctcagccctgatcggcctccggaacctggtgatgccgctccgtgccagcaactttcattaccatgagctcaagcacattgtgtttgtgggctctattgagtacctcaagcgggaatgggagacgcttcataacttccccaaagtgtccatattgcctggtacgccattaagtcgggctgatttaagggctgtcaacatcaacctctgtgacatgtgcgttatcctgtcagccaatcagaataatattgatgatacttcgctgcaggacaaggaatgcatcttggcgtcactcaacatcaaatctatgcagtttgatgacagcatcggagtcttgcaggctaattcccaagggttcacacctccaggaatggatagatcctctccagataacagcccagtgcacgggatgttacgtcaaccatccatcacaactggggtcaacatccccatcatcactgaactagtgaacgatactaatgttcagtttttggaccaagacgatgatgatgaccctgatacagaactgtacctcacgcagccctttgcctgtgggacagcatttgccgtcagtgtcctggactcactcatgagcgcgacgtacttcaatgacaatatcctcaccctgatacggaccctggtgaccggaggagccacgccggagctggaggctctgattgctgaggaaaacgcccttagaggtggctacagcaccccgcagacactggccaatagggaccgctgccgcgtggcccagttagctctgctcgatgggccatttgcggacttaggggatggtggttgttatggtgatctgttctgcaaagctctgaaaacatataatatgctttgttttggaatttaccggctgagagatgctcacctcagcacccccagtcagtgcacaaagaggtatgtcatcaccaacccgccctatgagtttgagctcgtgccgacggacctgatcttctgcttaatgcagtttgaccacaatgccggccagtcccgggccagcctgtcccattcctcccactcgtcgcagtcctccagcaagaagagctcctctgttcactccatcccatccacagcaaaccgacagaaccggcccaagtccagggagtcccgggacaaacagaagtacgtgcaggaagagcggctttgatatgtgtatccaccgccactgtgtgaaactgtatctgccactcatttccccagttggtgtttccaacaaagtaactttccctgttttcccctgtagtccccccctttttttttacacatatttgcatatgtatgatagtgtgcatgtggttgtcatttttatttcaccaccataaaacccttgagcacaacagcaaataagcagacggaccaaaagttatttatgattctgggggaaaaataacccaaaggcatgctccagacataaatagctcactgcaggaacgagttcacagattagaagggagcacttgtgatcaacgtcagttaggcagagcaagtttatttaatgtaaaagaaaagttgattctgatttatcaggattatcagggtgctttgggttttgattttgttgttgttgttgttttcctttctttctttttttatacacacaataagttagcacatgtttatttgaaacaagcaaccaaacagcaatgaaaacatattgattgtttccagt

SEQ ID NO: 182 - protein, 1230 aa, Homo sapiens
MANGGGGGGGSSGGGGGGGGSSLRMSSNIHANHLSLDASSSSSSSSSSSSSSSSSSSSSSVHEPKMDALIIPVTMEVPCDSRGQRMWWAFLASSMVTFFGGLFIILLWRTLKYLWTVCCHCGGKTKEAQKINNGSSQADGTLKPVDEKEEAVAAEVGWMTSVKDWAGVMISAQTLTGRVLVVLVFALSIGALVIYFIDSSNPIESCQNFYKDFTLQIDMAFNVFFLLYFGLRFIAANDKLWFWLEVNSVVDFFTVPPVFVSVYLNRSWLGLRFLRALRLIQFSEILQFLNILKTSNSIKLVNLLSIFISTWLTAAGFIHLVENSGDPWENFQNNQALTYWECVYLLMVTMSTVGYGDVYAKTTLGRLFMVFFILGGLAMFASYVPEIIELIGNRKKYGGSYSAVSGRKHIVVCGHITLESVSNFLKDFLHKDRDDVNVEIVFLHNISPNLELEALFKRHFTQVEFYQGSVLNPHDLARVKIESADACLILANKYCADPDAEDNIMRVISIKNYHPKIRIITQMLQYHNKAHLLNIPSWNWKEGDDAICLAELKLGFIAQSCLAQGLSTMLANLFSMRSFIKIEEDTWQKYYLEGVSNEMYTEYLSSAFVGLSFPTVCELCFVKLKLLMIAIEYKSANRESRILINPGNHLKIQEGTLGFFIASDAKEVKRAFFYCKACHDDITDPKRIKKCGCKRPKMSIYKRMRRACCFDCGRSDCSCMSGRVRGNVDTLERAFPLSSVSVNDCSTSFRAFEDEQPSTLSPKKKQRNGGMRNSPNTSPKLMRHDPLLIPGNDQIDNMDSNVKKYDSTGMFHWCAPKEIEKVILTRSEAAMTVLSGHVVVCIFGDVSSALIGLRNLVMPLRNFHYHELKHIVFVGSIEYLKREWETLHNFPKVSILPGTPLSRADLRAVNINLCDMCVILSANQNNIDDTSLQDKECILASLNIKSMQFDDSIGVLQANSQGFTPPGMDRSSPDNSPVHGMLRQPSITTGVNIPIITELVNDTNVQFLDQDDDDDPDTELYLTQPFACGTAFAVSVLDSLMSATYFNDNILTLIRTLVTGGATPELEALIAEENALRGGYSTPQTLANRDRCRVAQLALLDGPFADLGDGGCYGDLFCKALKTYNMLCFGIYRLRDAHLSTPSQCTKRYVITNPPYEFELVPTDLIFCLMQFDHNAGQSRASLSHSSHSSQSSSKKSSSVHSIPSTANRQNRPKSRESRDKQKYVQEERL

SEQ ID NO: 183 - DNA, 5012 bp, Homo sapiens
ccgggccgctgccgaggggccctgcccacccctgcccagcccggagcccaggcgagccagcgcggcgagcctcctcccctcccgcctgggtcgtcctgagtccgcgcccgctccagttgctgcagctgctgctgctggcggctgcggggagcgcggggcgcgcgccgaagaggcttgggcggcgaggacggggacgaggaggagtcggaggcggcaaggaggaagagcgagcggaggccgaggggctcagcggcgtggcgacaggactagggggtcccgagaacatgggctagcaggcggccacgggccggcggccggacgcggtgaacctgccgcggccgggcgcgcactggcgcggcgagccggagccgagcgcagccgggggaggagggctggcgcaggggcgcccgggcggagggggccgattatccattattaacgagttaccacctaataagcggagagcggctcgttagccgcgcgggaggcgctcggggaagggggtcaccggccgagcgcagcgcacacccgtggcgcacggcgggcggcgcggcgccgaggacacccgggaccgcgcgcggagccggggcgggcccgggggcggcgcagaccccgggcgcgggcggcccgcggcgccccctggctctcggcgctcggggccagcgcagcccggggcgagtggggcgcgggccggggagggggagctgcccgcgcactccatccccctcccccccgggcgggcggcggcggctcgctgtatatatctcggcgcaccccgccaggtcgcgcacagcgccccgagcccaggcgcctccccgcccccctcccgcgctccgcggcggcggcggcggcggcagcagtagcagcaatatggctgttgatgggtgtttggggtggcgctggcggcgggaggagctcccccgagcccctgcgccggctgcccgttgctagctatggcaaatggtggcggcggcggcggcggcagcagcggcggcggcggcggcggcggaggcagcagtcttagaatgagtagcaatatccacgcgaaccatctcagcctagacgcgtcctcctcctcctcctcctcctcttcctcttcttcttcttcctcctcctcttcctcctcgtcctcggtccacgagcccaagatggatgcgctcatcatcccggtgaccatggaggtgccgtgcgacagccggggccaacgcatgtggtgggctttcctggcctcctccatggtgactttcttcgggggcctcttcatcatcttgctctggcggacgctcaagtacctgtggaccgtgtgctgccactgcgggggcaagacgaaggaggcccagaagattaacaatggctcaagccaggcggatggcactctcaaaccagtggatgaaaaagaggaggcagtggccgccgaggtcggctggatgacctccgtgaaggactgggcgggggtgatgatatccgcccagacactgactggcagagtcctggttgtcttagtctttgctctcagcatcggtgcacttgtaatatacttcatagattcatcaaacccaatagaatcctgccagaatttctacaaagatttcacattacagatcgacatggctttcaacgtgttcttccttctctacttcggcttgcggtttattgcagccaacgataaattgtggttctggctggaagtgaactctgtagtggatttcttcacggtgccccccgtgtttgtgtctgtgtacttaaacagaagttggcttggtttgagatttttaagagctctgagactgatacagttttcagaaattttgcagtttctgaatattcttaaaacaagtaattccatcaagctggtgaatctgctctccatatttatcagcacgtggctgactgcagccgggttcatccatttggtggagaattcaggggacccatgggaaaatttccaaaacaaccaggctctcacctactgggaatgtgtctatttactcatggtcacaatgtccaccgttggttatggggatgtttatgcaaaaaccacacttgggcgcctcttcatggtcttcttcatcctcgggggactggccatgtttgccagctacgtccctgaaatcatagagttaataggaaaccgcaagaaatacgggggctcctatagtgcggttagtggaagaaagcacattgtggtctgcggacacatcactctggagagtgtttccaacttcctgaaggactttctgcacaaggaccgggatgacgtcaatgtggagatcgtttttcttcacaacatctcccccaacctggagcttgaagctctgttcaaacgacattttactcaggtggaattttatcagggttccgtcctcaatccacatgatcttgcaagagtcaagatagagtcagcagatgcatgcctgatccttgccaacaagtactgcgctgacccggatgcggaggatgcctcgaatatcatgagagtaatctccataaagaactaccatccgaagataagaatcatcactcaaatgctgcagtatcacaacaaggcccatctgctaaacatcccgagctggaattggaaagaaggtgatgacgcaatctgcctcgcagagttgaagttgggcttcatagcccagagctgcctggctcaaggcctctccaccatgcttgccaacctcttctccatgaggtcattcataaagattgaggaagacacatggcagaaatactacttggaaggagtctcaaatgaaatgtacacagaatatctctccagtgccttcgtgggtctgtccttccctactgtttgtgagctgtgttttgtgaagctcaagctcctaatgatagccattgagtacaagtctgccaaccgagagagccgtatattaattaatcctggaaaccatcttaagatccaagaaggtactttaggatttttcatcgcaagtgatgccaaagaagttaaaagggcatttttttactgcaaggcctgtcatgatgacatcacagatcccaaaagaataaaaaaatgtggctgcaaacggcttgaagatgagcagccgtcaacactatcaccaaaaaaaaagcaacggaatggaggcatgcggaactcacccaacacctcgcctaagctgatgaggcatgaccccttgttaattcctggcaatgatcagattgacaacatggactccaatgtgaagaagtacgactctactgggatgtttcactggtgtgcacccaaggagatagagaaagtcatcctgactcgaagtgaagctgccatgaccgtcctgagtggccatgtcgtggtctgcatctttggcgacgtcagctcagccctgatcggcctccggaacctggtgatgccgctccgtgccagcaactttcattaccatgagctcaagcacattgtgtttgtgggctctattgagtacctcaagcgggaatgggagacgcttcataacttccccaaagtgtccatattgcctggtacgccattaagtcgggctgatttaagggctgtcaacatcaacctctgtgacatgtgcgttatcctgtcagccaatcagaataatattgatgatacttcgctgcaggacaaggaatgcatcttggcgtcactcaacatcaaatctatgcagtttgatgacagcatcggagtcttgcaggctaattcccaagggttcacacctccaggaatggatagatcctctccagataacagcccagtgcacgggatgttacgtcaaccatccatcacaactggggtcaacatccccatcatcactgaactagtgaacgatactaatgttcagtttttggaccaagacgatgatgatgaccctgatacagaactgtacctcacgcagccctttgcctgtgggacagcatttgccgtcagtgtcctggactcactcatgagcgcgacgtacttcaatgacaatatcctcaccctgatacggaccctggtgaccggaggagccacgccggagctggaggctctgattgctgaggaaaacgcccttagaggtggctacagcaccccgcagacactggccaatagggaccgctgccgcgtggcccagttagctctgctcgatgggccatttgcggacttaggggatggtggttgttatggtgatctgttctgcaaagctctgaaaacatataatatgctttgttttggaatttaccggctgagagatgctcacctcagcacccccagtcagtgcacaaagaggtatgtcatcaccaacccgccctatgagtttgagctcgtgccgacggacctgatcttctgcttaatgcagtttgaccacaatgccggccagtcccgggccagcctgtcccattcctcccactcgtcgcagtcctccagcaagaagagctcctctgttcactccatcccatccacagcaaaccgacagaaccggcccaagtccagggagtcccgggacaaacagaagtacgtgcaggaagagcggctttgatatgtgtatccaccgccactgtgtgaaactgtatctgccactcatttccccagttggtgtttccaacaaagtaactttccctgttttcccctgtagtccccccctttttttttacacatatttgcatatgtatgatagtgtgcatgtggttgtcatttttatttcaccaccataaaacccttgagcacaacagcaaataagcagacggaccaaaagttatttatgattctgggggaaaaataacccaaaggcatgctccagacataaatagctcactgcaggaacgagttcacagattagaagggagcacttgtgatcaacgtcagttaggcagagcaagtttatttaatgtaaaagaaaagttgattctgatttatcaggattatcagggtgctttgggttttgattttgttgttgttgttgttttcctttctttctttttttatacacacaataagttagcacatgtttatttgaaacaagcaaccaaacagcaatgaaaacatattgattgtttccagt

SEQ ID NO: 184 - protein, 1174 aa, Homo sapiens
MANGGGGGGGSSGGGGGGGGSSLRMSSNIHANHLSLDASSSSSSSSSSSSSSSSSSSSSSVHEPKMDALIIPVTMEVPCDSRGQRMWWAFLASSMVTFFGGLFIILLWRTLKYLWTVCCHCGGKTKEAQKINNGSSQADGTLKPVDEKEEAVAAEVGWMTSVKDWAGVMISAQTLTGRVLVVLVFALSIGALVIYFIDSSNPIESCQNFYKDFTLQIDMAFNVFFLLYFGLRFIAANDKLWFWLEVNSVVDFFTVPPVFVSVYLNRSWLGLRFLRALRLIQFSEILQFLNILKTSNSIKLVNLLSIFISTWLTAAGFIHLVENSGDPWENFQNNQALTYWECVYLLMVTMSTVGYGDVYAKTTLGRLFMVFFILGGLAMFASYVPEIIELIGNRKKYGGSYSAVSGRKHIVVCGHITLESVSNFLKDFLHKDRDDVNVEIVFLHNISPNLELEALFKRHFTQVEFYQGSVLNPHDLARVKIESADACLILANKYCADPDAEDNIMRVISIKNYHPKIRIITQMLQYHNKAHLLNIPSWNWKEGDDAICLAELKLGFIAQSCLAQGLSTMLANLFSMRSFIKIEEDTWQKYYLEGVSNEMYTEYLSSAFVGLSFPTVCELCFVKLKLLMIAIEYKSANRESRILINPGNHLKIQEGTLGFFIASDAKEVKRAFFYCKACHDDITDPKRIKKCGCKRLEDEQPSTLSPKKKQRNGGMRNSPNTSPKLMRHDPLLIPGNDQIDNMDSNVKKYDSTGMFHWCAPKEIEKVILTRSEAAMTVLSGHVVVCIFGDVSSALIGLRNLVMPLRNFHYHELKHIVFVGSIEYLKREWETLHNFPKVSILPGTPLSRADLRAVNINLCDMCVILSANQNNIDDTSLQDKECILASLNIKSMQFDDSIGVLQANSQGFTPPGMDRSSPDNSPVHGMLRQPSITTGVNIPIITELVNDTNVQFLDQDDDDDPDTELYLTQPFACGTAFAVSVLDSLMSATYFNDNILTLIRTLVTGGATPELEALIAEENALRGGYSTPQTLANRDRCRVAQLALLDGPFADLGDGGCYGDLFCKALKTYNMLCFGIYRLRDAHLSTPSQCTKRYVITNPPYEFELVPTDLIFCLMQFDHNAGQSRASLSHSSHSSQSSSKKSSSVHSIPSTANRQNRPKSRESRDKQKYVQEERL
